(12) United States Patent
Meinke et al.

(10) Patent No.: US 8,529,910 B2
(45) Date of Patent: Sep. 10, 2013

(54) ENTEROCOCCUS ANTIGENS

(75) Inventors: Andreas Meinke, Pressbaum (AT); Eszter Nagy, Vienna (AT); Markus Hanner, Vienna (AT); Dieter Gelbmann, Vienna (AT)

(73) Assignee: Intercell Austria AG, Vienna (AT)

( * ) Notice: Subject to any disclaimer, the term of this patent is extended or adjusted under 35 U.S.C. 154(b) by 0 days.

(21) Appl. No.: 13/073,742

(22) Filed: Mar. 28, 2011

(65) Prior Publication Data

US 2011/0243978 A1 Oct. 6, 2011

Related U.S. Application Data

(63) Continuation of application No. 10/558,119, filed as application No. PCT/EP2004/005664 on May 26, 2004, now abandoned.

(30) Foreign Application Priority Data

May 30, 2003 (EP) .................................. 03450137

(51) Int. Cl.
  *A61K 39/00* (2006.01)
  *A61K 39/02* (2006.01)
  *A61K 38/00* (2006.01)
  *C07K 1/00* (2006.01)

(52) U.S. Cl.
  USPC .................. 424/234.1; 424/184.1; 424/190.1; 530/300; 530/350

(58) Field of Classification Search
  None
  See application file for complete search history.

(56) References Cited

U.S. PATENT DOCUMENTS

| | | | |
|---|---|---|---|
| 4,946,778 A | 8/1990 | Ladner et al. | 435/69.6 |
| 5,849,902 A | 12/1998 | Arrow et al. | 536/24.5 |
| 5,989,912 A | 11/1999 | Arrow et al. | 435/375 |
| 6,583,275 B1 | 6/2003 | Doucette-Stamm et al. | 536/23.1 |
| 6,617,156 B1 | 9/2003 | Doucette-Stamm et al. | 435/320.1 |
| 7,615,616 B2 | 11/2009 | Hook et al. | |
| 2002/0045737 A1 | 4/2002 | Choi et al. | 536/23.1 |
| 2008/0175856 A1 | 7/2008 | Meinke et al. | |
| 2012/0082674 A1 | 4/2012 | Meinke et al. | |

FOREIGN PATENT DOCUMENTS

| | | |
|---|---|---|
| JP | JP 2001-519402 | 10/2001 |
| WO | WO 97/30721 | 8/1997 |
| WO | WO 01/78767 | 10/2001 |
| WO | WO 02/13857 | 2/2002 |
| WO | WO 02/059148 | 8/2002 |
| WO | WO 02/077183 | 10/2002 |
| WO | WO-2004/025416 A2 | 3/2004 |
| WO | PCT/EP2004/005664 | 1/2005 |
| WO | PCT/EP2004/005664 | 12/2005 |

OTHER PUBLICATIONS

U.S. Appl. No. 60/410,303, filed Sep. 13, 2002, Hook et al.
"Infection," Defined in: *The American Heritage Stedman's Medical Dictionary*, p. 412, 2002.
Abbas et al., "Immunity in defense and disease," In: *Cellular and Molecular Immunology* 4th Ed., Ch. 15: 360-362, 2000.
An et al., "Identification of the cAD1 Sex Pheromone Precursor in *Enterococcus faecalis*," *Journal of Bacteriology*, 184(7):1880-1887, 2002.
Burnie and Matthews, "The renaissance of antibody therapy," *J Antimicrob Chemother*, 41: 319-22, 1998.
Cetinkaya et al., "Vancomycin-resistant enterococci.," *Clin Microbiol Rev*, 13: 686-707, 2000.
Database Geneseq, "*E. faecium* protein sequence SEQ ID 6586," EBI Accession No. ADC96959, 2004.
Database Geneseq, "*Enterococcus faecalis* contig sequence #464," EBI Accession No. ABS99196, 2002.
Database Geneseq, "*Enterococcus faecalis* polypeptide #1547," Database Accession No. ADH87067, 2004.
Database Geneseq, "Protein encoded by Prokaryotic essential gene #14577," Database Accession No. ABU29050, 2003.
Database UniProt, "Mannose-specific phosphotransferase system component IIAB. VLFLVDLWGG TPFNQANSLF EEHKDKWAIV AGMNLPMVIE AYGARLSMES AEIAASIIS," EBI Accession No. Q97TN2, 2001.
Database UniProt, "PTS system, mannose-specific IIAB components, VLFLVDLWGG TPFNQANSLL EDHKDKWAIV AGMNLPMVIE AYASRFSMES AQEIATHILE," EBI Accession No. Q839X9, 2003.
Ellis et al., "New Techniques for Making Vaccines," Chapter 29, In: Plotkin et al. Ed., *Vaccines*, Philidelphia: W.B. Saunders Company, 1988.
Etz et al., "Bacterial phage receptors, versatile tools for display of polypeptides on the cell surface," *J Bacteriol*, 183: 6924-35, 2001.
European Search Report issued in Application No. 10178463.5-2405, mailing date Nov. 17, 2010.
French, "Enterococci and vancomycin resistance," *Clin Infect Dis*, 27: S75-83, 1998.
Gaglani et al., "Contribution of antibody to neutrophil-mediated killing of *Enterococcus faecalis*," *J Clin Immunol*, 17: 478-84, 1997.
GenBank Accession No. AF421355, "*Enterococcus faecalis*," 2002.
GenBank Accession No. NP_813831, "*Enterococcus faecalis* V583," 2003.
Georgiou et al., "Display of heterologous proteins on the surface of microorganisms: from the screening of combinatorial libraries to live recombinant vaccines," *Nature Biotechnology*, 15: 29-34, 1997.
Gold, "Vancomycin-resistant enterococci: mechanisms and clinical observations," *Clin Infect Dis*, 33: 210-9, 2001.
Haas et al., "Two-component regulator of *Enterococcus faecalis* cytolysin respondes to quorum-sensing autoinduction," *Nature*, 415: 84-7, 2002.

(Continued)

*Primary Examiner* — Oluwatosin Ogunbiyi

(74) *Attorney, Agent, or Firm* — Wolf, Greenfield & Sacks, P.C.

(57) ABSTRACT

The present invention discloses isolated nucleic acid molecules encoding a hyperimmune serum reactive antigen or a fragment thereof as well as hyperimmune serum reactive antigens or fragments thereof from *E. faecalis*, methods for isolating such antigens and specific uses thereof.

18 Claims, 5 Drawing Sheets

(56) References Cited

OTHER PUBLICATIONS

Hashemzadeh-Bonehi et al., "Importance of using lac rather than ara promoter vectors for modulating the levels of toxic gene products in *Escherichia coli*," *Mol Microbiol*, 30: 676-678, 1998.

Hemmer et al., "Identification of candidate T-cell epitopes and molecular mimics in chronic Lyme disease," *Nat Med*, 5: 1375-82, 1999.

Henics et al., "Small-fragment genomic libraries for the display of putative epitopes from clinically significant pathogens," *Biotechniques*, 35:196-200, 2003.

Huebner et al., "Prophylactic and therapeutic efficacy of antibodies to a capsular polysaccharide shared among vancomycin-sensitive and -resistant enterococci," *Infect Immun*, 68: 4631-6, 2000.

Japanese Office Action, issued in Application No. 2006-529922, mailing date: Mar. 23, 2010 (English Translation included).

Japanese Office Action, issued in Application No. 2006-529992, mailing date: Feb. 8, 2011 (English Translation included).

Jett et al., "Virulence of enterococci," *Clin Microbial Rev*, 7: 462-78, 1994.

Kajava et al., "The net charge of the first 18 residues of the mature sequence affects protein translocation across the cytoplasmic membrane of gram-negative bacteria," *J Bacteriol*, 182: 2163-9, 2000.

Koch et al., "Treatment and prevention of enterococcal infections—alternative and experimental approaches," *Expert Opinion Biol. Ther.*, 4(9):1519-1531, 2004.

Lowe et al., "Cloning of an *Enterococcus faecalis* endocarditis antigen: homology with adhesins from some oral streptococci," *Infect Immun*, 63: 703-6, 1995.

Marks et al., "By-passing immunization: building high affinity human antibodies by chain shuffling," *Biotechnology* (N Y), 10: 779-83, 1992.

McCormick et al., "Antibodies to a surface-exposed, N-terminal domain of aggregation substance are not protective in the rabbit model of *Enterococcus faecalis* infective endocarditis," *Infect Immun*, 69: 3305-14, 2001.

Meinke et al., "Bacterial genomes pave the way to novel vaccines," *Current Opinion in Microbiology*, 7:314-320, 2004.

Murray, "The Life and Times of *Enterococcus*," *Clin Microbiol Rev*, 3: 46-65, 1990.

Navarre and Schneewind, "Surface proteins of gram-positive bacteria and mechanisms of their targeting to the cell wall envelope," *Microbiol Mol Biol Rev*, 63: 174-229, 1999.

Noble et al., "Co-transfer of vancomycin and other resistance genes from *Enterococcus faecalis* NCTC 12201 to *Staphylococcus aureus*," *FEMS Microbiol Lett*, 72: 195-8, 1992.

Office Communication, issued in U.S. Appl. No. 10/558,119, dated Sep. 29, 2010.

Office Communication, issued in U.S. Appl. No. 10/558,119, dated Jan. 20, 2010.

Office Communication, issued in U.S. Appl. No. 10/558,119, dated May 6, 2009.

Office Communication, issued in U.S. Appl. No. 10/558,119, dated Aug. 19, 2008.

Office Communication, issued in U.S. Appl. No. 10/558,119, dated May 9, 2008.

Paulsen et al., "Role of Mobile DNA in the Evolution of Vancomycin-Resistant *Enterococcus faecalis*," *Science* 299:2071-4, 2003.

Poyart et al., "Emergence of vancomycin resistance in the genus *Streptococcus*: characterization of a vanB transferable determinant in *Streptococcus bovis*," *Antimicrob Agents Chemother*, 41: 24-9, 1997.

Rammensee et al., "SYFPEITHI: database for MHC ligands and peptide motifs," *Immunogenetics*, 50: 213-9, 1999.

Revision history, Gen Bank Accession No. AF421355, accessed Feb. 2, 2011.

Revision history, Gen Bank Accession No. NP_813831, accessed May 5, 2008.

Rice, "Emergence of vancomycin-resistant enterococci," *Emerg Infect Dis*, 7: 183-7, 2001.

Richards et al., "Nosocomial infections in combined medical-surgical intensive care units in the United States," *Infect Control Hosp Epidemiol*, 21: 510-5, 2000.

Rosenshine et al., "Tyrosine protein kinase inhibitors block invasin-promoted bacterial uptake by epithelial cells," *Infect Immun*, 60: 2211-7, 1992.

SCORE Search Report, Seq. No. 233 (Choi et al.), Accessed online Jul. 7, 2008.

Shankar et al., "Infection-derived *Enterococcus faecalis* strains are enriched in esp, a gene encoding a novel surface protein," *Infect Immun*, 67: 193-200, 1999.

Supporting online material for : Paulsen et al., "Role of Mobile DNA in the Evolution of Vancomycin-Resistant *Enterococcus faecalis*," *Science* 299:2071-4, 2003. DOI No. 10.1126/science.1080613, Accessed online May 5, 2008.

Sussmuth et al., "Aggregation substance promotes adherence, phagocytosis, and intracellular survival of *Enterococcus faecalis* within human macrophages and suppresses respiratory burst," *Infect Immun*, 68: 4900-6, 2000.

Tourdot et al., "A general strategy to enhance immunogenicity of low-affinity HLA-A2.1-associated peptides: implication in the identification of cryptic tumor epitopes," *Eur J Irnmunol*, 30: 3411-21, 2000.

Whitnack and Beachey, "Inhibition of complement-mediated opsonization and phagocytosis of *Streptococcus* pyogenes by D fragments of fibrinogen and fibrin bound to cell surface M protein," *J Exp Med* 162: 1983-97, 1985.

Xu et al., "*Enterococcus faecalis* antigens in human infections," *Infect Immun*, 65: 4207-15, 1997.

ENTEROCOCCUS ANTIGENS

CROSS-REFERENCE TO RELATED APPLICATIONS

This application is a continuation of U.S. application Ser. No. 10/558,119 filed 23 Nov. 2005, now abandoned, which is a national phase application under 35 U.S.C. §371 of International Application No. PCT/EP2004/005664 filed 26 May 2004, which claims priority to European Application No. 03450137.9 filed 30 May 2003. The entire text of each of the above-referenced disclosures is specifically incorporated herein by reference.

The present invention relates to isolated nucleic acid molecules, which encode antigens for Enterococci, e.g. Enterococci faecalis, which are suitable for use in preparation of pharmaceutical medicaments for the prevention and treatment of bacterial infections caused by Enterococci.

Enterococci are gram-positive bacteria that are normal inhabitants of the alimentary tract of humans and animals. They have been recognized as a cause of infective endocarditis for more than a century {Murray, B., 1990} and have gained prominence over the last two decades as being among the most common pathogens found in hospital-acquired infections, and surgical-site infections {Richards, M. et al., 2000}. The increasing importance of enterococci as nosocomial pathogens can be attributed in part to intrinsic and acquired antibiotic resistance {Murray, B., 1990}; {Rice, L., 2001}. Treatment of multi-drug-resistent enterococcal infections poses a significant challenge to clinicians {Cetinkaya, Y. et al., 2000}; {Gold, H., 2001}, and the potential of these organisms to serve as a reservoir for antibiotic resistance genes is of great concern {French, G., 1998}; {Noble, W. et al., 1992}; {Poyart, C. et al., 1997}.

The classification of enterococci as group D streptococci dates back to the early 1930's. In 1984, enterococci were given formal genus status after several studies demonstrated a more distant relationship with the streptococci.

Enterococci are generally considered commensals of the gastrointestinal tract of a variety of organisms including man. Although there are more than 14 different species of enterococci, *E. faecalis* and *E. faecium* are the species most commonly found in humans. Several intrinsic features of *Enterococcus* may allow members of this genus to survive for extended periods of time, leading to its persistence and nosocomial spread. The ability of enterococci to adapt and persist in the presence of detergents may allow them to survive inadequate cleaning regimens, contributing to their persistence in the hospital. The intrinsic ruggedness of enterococci also confers an unusual level of tolerance to several classes of antibiotics including aminoglycosides, β-lactams and quinolones. For example, the resistance of enterococci to aminoglycosides results from the ability of enterococci to block the uptake of the drug at the cell wall. Although the mechanism of high-level resistance was determined to be the result of a bifunctional enzyme {Ferretti, J. et al., 1986}, the molecular basis for the intrinsic resistance of enterococci to low-levels of aminoglycosides remains to be determined.

Among the Enterococci, *E. faecium* is unique because it is commonly used in production of fermented foods, and is also used as a probiotic bacterium. In recent years, *E. faecium* has been less acceptable as a food fermentation organism because of concern that this bacterium may be an intermediate host for spreading of antibiotic resistance to bacteria involved in human infections. Despite these concerns, *E. faecium* is still amongst the most common bacteria found in foods fermented by lactic acid bacteria. Many isolates of *E. faecium* have been shown to produce bacteriocins (antimicrobial peptides) that are able to kill or inhibit growth of pathogens such as *listeria*, clostridia, bacilli, and staphylococci. Such bacteriocins may contribute to the preservative effect of food fermentations, and is one reason why they have been chosen as starter cultures in the production of fermented food. Recently, enterocins have been implemented successfully in treatment of mastitis in cattle.

Besides the applications for food production, as probiotics and in treatment of animal disease, and more importantly, enterococci are emerging opportunistic human pathogens. This is due to their intrinsic pathogenic potential, and, even more because of their ability to rapidly acquire antibiotic resistance genes. *E. faecium* and *E. faecalis* are the causing agents of a large percentage of hospital-acquired infections, including superinfections.

Enterococci normally colonize the gastrointestinal tract of man. They are found in relative abundance in human feces. A close association is likely to exist between enterococci and their host, or the organism would be eliminated due to normal intestinal motility. Many infection-derived enterococcal isolates were found to be clonal, indicating nosocomial transmission. Moreover, a number of studies have documented patient colonization following hospital admission, and have shown that colonization with multiple resistant strains is a predisposing factor for subsequent infection.

One of the enigmas of nosocomial enterococcal infection not easily explained is the ready colonization of an ecology already occupied by members of the same species. As noted, antibiotics lacking substantial anti-enterococcal activity (i.e. antibiotics that do not deleteriously affect indigenous enterococci) are important predisposing factors for infection. These infections are frequently caused by multiple resistant enterococcal isolates that have been exogenously acquired and appear to have out competed indigenous enterococci in the absence of direct selection.

The fact that exogenous, multiple resistant, nosocomially transmitted enterococci efficiently colonize the gastrointestinal tract suggests that they may not compete directly for the same niche as indigenous strains.

Infection caused by the genus *Enterococcus* include a) bacteremia, b) urinary tract infections c) endophthalmitis, d) endocarditis and also wound and intra-abdominal infections. Approximately ¾ of the infections are caused by the species *E. faecalis*, the rest by *E. faecium*.

a) Bacteremia

Nosocomial surveillance data for the period October 1986-April 1997 list enterococci as the third most common cause of nosocomial bacteremia, accounting for 12.8% of all isolates. The translocation of enterococci across an intact intestinal epithelial barrier is thought to lead to many bacteremias with no identifiable source. The risk factors for mortality associated with enterococcal bacteremia include severity of illness, patient age, and use of broad spectrum antibiotics, such as third-generation cephalosporins or metronidazole. These studies suggest that high-level aminoglycoside resistance does not affect clinical outcome, and that the presence of the *E. faecalis* cytolysin (hemolysin) may enhance the severity of the infection.

b) Urinary Tract Infections

Enterococci have been estimated to account for 110,000 urinary tract infections (UTI) annually in the United States. A few studies have been aimed at understanding the interaction of enterococci with uroepithelial tissue. A potential role for the plasmid-encoded aggregation substance in the adhesion of enterococci to renal epithelial cells has been demonstrated. *E. faecalis* harboring the pheromone responsive plasmid pAD1, or various isogenic derivatives, were better able to bind to the cultured pig renal tubular cell line, LLC-PK, than plasmid free cells. Their findings also showed that a synthetic peptide containing the fibronectin motif, Arg-Gly-Asp-Ser, could inhibit binding. This structural motif mediates the interaction between fibronectin and eucaryotic surface receptors of the integrin family.

c) Endophthalmitis

Colonization of host tissue may play a role in the pathogenesis of endophthalmitis. Enterococci are among the most destructive agents that cause this post-operative complication of cataract surgery. Experiments designed to determine whether aggregation substance targeted E. faecalis to alternate anatomical structures within the eye showed that enterococci attach to membranous structures in the vitreous, but that such adherence is not dependent on the presence of aggregation substance.

d) Endocarditis

Of the diverse infections caused by enterococci, infective endocarditis (IE) is one of the most therapeutically challenging. Enterococci are the third leading cause of infective endocarditis, accounting for 5-20% of cases of native valve IE, and 6-7% of prosthetic valve endocarditis. The presence of the pheromone-responsive plasmid pAD1 enhances vegetation formation in enterococcal endocarditis. Serum from a patient with E. faecalis endocarditis was used to identify an antigen selectively expressed in serum but not in broth culture {Lowe, A. et al., 1995}. This protein antigen, designated EfaA, has extensive sequence similarity with several streptococcal adhesions and might function as an important adhesin in endocarditis.

Ampicillin is the therapy of choice for enterococcal infections. For serious enterococcal infection, particularly for endocarditis, aminoglycosides are critical as part of combination therapy with penicillin or ampicillin. Although enterococci are intrinsically resistant to low levels of aminoglycosides, the addition of the cell wall inhibitors to aminoglycoside will result in an enhanced killing by the synergictic action of the two antimicrobials. With the increasing incidence of high level resistance to aminoglycosides and penicillins, vancomycin has become the only choice available for the treatment of enterococcal infections. Then, vancomycin resistance was reported in clinical isolates of enterococci in 1988, followed by an outbreak caused by vancomycin-resistant enterococci (VRE). In U.S. hospitals the percentage of nosocomial enterococci resistant to vancomycin increased from 0.3% in 1989 to 7.9% in 1993. Among patients in intensive care units with nosocomial infections an increase was even more dramatic; from 0.4% in 1989 to 13.6% in 1993, a 34-fold increase in the 4-year period.

In addition to a higher mortality rate, vancomycin-resistant enterococcal infections cost on average about $25,000 more to treat and doubled the patients' length of stay in the hospital.

The dramatic increase in vancomycin resistance, especially among E. faecium isolates, indicates that enterococcal infection will pose an increasing challenge in the future. An obvious therapeutic alternative is vaccination with the aim to induce protective immune responses, which prevents or attenuates infections.

Vaccine development is hindered by the lack of sufficient knowledge about the elements of protective immunity against enterococcal infections. There are reports that neutrophil mediated killing of enterococci was largely a function of complement with antibody playing a less essential but potentially important role, though additional evidence for the importance of anti-enterococcal antibodies in promoting clearance by opsonophagocytic killing was recently reported {Gaglani, M. et al., 1997}.

The importance of surface proteins in human immunity to Enterococcus already has been appreciated. It is apparent that all clinical isolates express surface proteins with activity relevant to host immune defense. The enterococcal surface protein (Esp) {Shankar, V. et al., 1999}, gelatinase, cytolysin {Haas, W. et al., 2002} and aggregation substance (AS) surface protein {Sussmuth, S. et al., 2000} are well-characterized biochemically and genetically, and have also been shown to be immunogenic {Xu, Y. et al., 1997}. In an animal model of infective endocarditis specific antibodies against the aggregation substance were still not protective {McCormick, J. et al., 2001}.

Thus, there remains a need for an effective treatment to prevent or ameliorate enterococcal infections. Vaccines capable of showing cross-protection against the majority of Enterococcus strains causing human infections could also be useful to prevent or ameliorate infections caused by all other enterococcal species, namely E. faecalis and E. faecium.

A vaccine can contain a whole variety of different antigens. Examples of antigens are whole-killed or attenuated organisms, subfractions of these organisms/tissues, proteins, or, in their most simple form, peptides. Antigens can also be recognized by the immune system in form of glycosylated proteins or peptides and may also be or contain polysaccharides or lipids. Short peptides can be used since for example cytotoxic T-cells (CTL) recognize antigens in form of short usually 8-11 amino acids long peptides in conjunction with major histocompatibility complex (MHC). B-cells can recognize linear epitopes as short as 4-5 amino acids, as well as three-dimensional structures (conformational epitopes). In order to obtain sustained, antigen-specific immune responses, adjuvants need to trigger immune cascades that involve all cells of the immune system necessary. Primarily, adjuvants are acting, but are not restricted in their mode of action, on so-called antigen presenting cells (APCs). These cells usually first encounter the antigen(s) followed by presentation of processed or unmodified antigen to immune effector cells. Intermediate cell types may also be involved. Only effector cells with the appropriate specificity are activated in a productive immune response. The adjuvant may also locally retain antigens and co-injected other factors. In addition the adjuvant may act as a chemoattractant for other immune cells or may act locally and/or systemically as a stimulating agent for the immune system.

Currently vaccines against enterococcal infection are only in the research stages of development. Efforts are focused not only on capsular polysaccharide (CPS) as immunogens {Huebner, J. et al., 2000}, but also on virulence factors and membrane/surface proteins.

The development of protein conjugated vaccines are no doubt a great new addition to the amarmatorium in the battle against enterococcal infections, but the vaccine can contain only a limited number of enterococcal proteins and given adequate ecological pressure, variation of the pathogenicity island and plasmids by non-vaccine clinical isolates remains a real threat. Moreover polysaccharide antigens used for active immunization do not provide immunological memory in humans. Conjugation of CPS to non-enterococcal related immunogenic protein carriers (e.g. tetanus toxoid, cholera toxin B subunit, etc.) has been shown to beneficial in inducing higher concentrations of antibodies in vaccines, but it does not provide pathogen-specific B cell and T cell epitopes which would recruit memory B and T cells during a real infection to support the most effective host response. To be able to supplement the enterococcal vaccines with proteins fulfilling these criteria it is necessary to identify conserved immunogenic enterococcal-specific surface proteins.

There is a great potential for passive antibody-based therapy. There have been already attempts to use human intravenous immunoglobulin (IVIG) preparations for prevention. Recent advances in the technology of monoclonal antibody production provide the means to generate human antibody reagents and reintroduce antibody therapies, while avoiding the toxicities associated with serum therapy. Immunoglobulins are an extremely versatile class of antimicrobial proteins that can be used to prevent and treat emerging infectious diseases. Antibody therapy has been effective against a variety of diverse microorganisms reviewed in {Burnie, J. et al., 1998}. Anti-enterococcal mAB could be given therapeutically to immunosuppressed patient, due to organ transplantation, cancer, HIV infection and other causes.

Certain proteins or enzymes displayed on the surface of gram-positive organisms significantly contribute to pathogenesis, are involved in the disease process caused by these pathogens. Often, these proteins are involved in direct interactions with host tissues or in concealing the bacterial surface from the host defense mechanisms {Navarre, W. et al., 1999}. *E. faecalis* is not an exception in this regard. Several surface proteins are characterized as virulence factors, important for enterococcal pathogenicity reviewed in {Jett, B. et al., 1994}. If antibodies to these proteins could offer better protection to humans then polysaccharides, they could provide the source of a novel, protein-based enterococcal vaccine to be used in conjunction with or in place of the more traditional capsular polysaccharide vaccine. The use of some of the above-described proteins as antigens for a potential vaccine as well as a number of additional candidates resulted mainly from a selection based on easiness of identification or chance of availability. There is a demand to identify relevant antigens for *E. faecalis* in a more comprehensive way.

The present inventors have developed a method for identification, isolation and production of hyperimmune serum reactive antigens from a specific pathogen, especially from *Staphylococcus aureus* and *Staphylococcus epidermidis* (WO 02/059148). However, given the differences in biological property, pathogenic function and genetic background, *Enterococcus faecalis* is distinctive from *Staphylococcus* strains. In order to identify relevant serum sources three major types of human sera were collected from healthy adults, as well from patients with enterococcal infections and naïve individuals, young children between 5 and 10 months of age, after they already lost maternal antibodies (as negative controls). A large percentage of individuals are exposed to enterococci in the environment that can induce antibodies in the host. Disease, which mainly occurs in hospitals, might be associated with low levels of specific antibodies against Enterococci, and consequently less efficient phagocytic elimination. To select for appropriate screening reagents, a series of immunoassays (mainly ELISA and immunoblotting) were performed with bacterial lysate and culture supernatant proteins to measure anti-*E. faecalis* IgG antibody levels. Sera from high titer individuals were included in the genomic-based antigen identification.

The genomes of the two bacterial species *E. faecalis* and *S. aureus* by itself show a number of important differences. The genome of *E. faecalis* contains app. 3.22 Mb, while *S. aureus* harbours 2.85 Mb. They have an average GC content of 37.5 and 33%, respectively and approximately ⅓ of the encoded genes are not shared between the two pathogens. In addition, the two bacterial species require different growth conditions and media for propagation. A list of the most important diseases, which can be inflicted by the two pathogens is presented below. *S. aureus* causes mainly nosocomial, opportunistic infections: impetigo, folliculitis, abscesses, boils, infected lacerations, endocarditis, meningitis, septic arthritis, pneumonia, osteomyelitis, scalded skin syndrome (SSS), toxic shock syndrome. *E. faecalis* causes mainly infections which are not highly toxigenic, highly invasive, or highly infectious by most measures. They do, nevertheless, cause a substantial amount of human disease such as bacteremia, urinary tract infections, endocarditis and intra-abdominal infections.

The complete genome sequence of *E. faecalis* V583, a vancomycin-resistant clinical isolate, was determined by the random shotgun sequencing strategy (GenBank accession number for chromosome and the plasmids are as follows: AE016830 (chromosome), AE016833 (pTEF1), AE016831 (pTEF2), AE016832 (pTEF3)); see {Paulsen, I. et al., 2003}.

The complete genome of *E. faecium* strain DO (ATCC BAA-472, TEX16, TX0016) with an estimated genome size of 2.8 Mbp has been sequenced. The genome is currently being computed and annotated by the Baylor College of Medicine's Human Genome Sequencing Center and the University of Texas Center for the Study for Emerging and Re-emerging Pathogens (CSERP); see: www.hgsc.bcm.tmc.edu/microbial/Efaecium/

The problem underlying the present invention was to provide means for the development of medicaments such as vaccines against *E. faecalis* infection. More particularly, the problem was to provide an efficient, relevant and comprehensive set of nucleic acid molecules or hyperimmune serum reactive antigens from *E. faecalis* that can be used for the manufacture of said medicaments.

Therefore, the present invention provides an isolated nucleic acid molecule encoding a hyperimmune serum reactive antigen or a fragment thereof comprising a nucleic acid sequence which is selected from the group consisting of:
  a) a nucleic acid molecule having at least 70% sequence identity to a nucleic acid molecule selected from Seq ID No 1-2, 4-8, 10, 12-18, 20-23, 25-26, 29-43, 45-62, 64-74, 76-77, 79-83, 85-89, 91-92, 94-114, 117-126, 128-146, 148-170, 373, 375, 379-381, 387, 392, 394, 397-399, 407-408, 410-411 and 415-424.
  b) a nucleic acid molecule which is complementary to the nucleic acid molecule of a),
  c) a nucleic acid molecule comprising at least 15 sequential bases of the nucleic acid molecule of a) or b)
  d) a nucleic acid molecule which anneals under stringent hybridisation conditions to the nucleic acid molecule of a), b), or c)
  e) a nucleic acid molecule which, but for the degeneracy of the genetic code, would hybridise to the nucleic acid molecule defined in a), b), c) or d).

According to a preferred embodiment of the present invention the sequence identity is at least 80%, preferably at least 95%, especially 100%.

Furthermore, the present invention provides an isolated nucleic acid molecule encoding a hyperimmune serum reactive antigen or a fragment thereof comprising a nucleic acid sequence selected from the group consisting of
  a) a nucleic acid molecule having at least 96%, preferably at least 98%, especially 100% sequence identity to a nucleic acid molecule selected from Seq ID No 3, 9, 11, 24, 27, 44, 63, 75, 84, 115-116, 127, 374, 376-378, 382-386, 388-391, 393, 395-396, 400-406, 409 and 412-414,
  b) a nucleic acid molecule which is complementary to the nucleic acid molecule of a), c) a nucleic acid molecule comprising at least 15 sequential bases of the nucleic acid molecule of a) or b)
d) a nucleic acid molecule which anneals under stringent hybridisation conditions to the nucleic acid molecule of a), b) or c),
e) a nucleic acid molecule which, but for the degeneracy of the genetic code, would hybridise to the nucleic acid defined in a), b), c) or d).

According to another aspect, the present invention provides an isolated nucleic acid molecule comprising a nucleic acid sequence selected from the group consisting of
a) a nucleic acid molecule selected from Seq ID No 90, 147.
b) a nucleic acid molecule which is complementary to the nucleic acid of a),
c) a nucleic acid molecule which, but for the degeneracy of the genetic code, would hybridise to the nucleic acid defined in a), b), c) or d).

Preferably, the nucleic acid molecule is DNA or RNA.

According to a preferred embodiment of the present invention, the nucleic acid molecule is isolated from a genomic DNA, especially from a E. faecalis genomic DNA.

According to the present invention a vector comprising a nucleic acid molecule according to any of the present invention is provided.

In a preferred embodiment the vector is adapted for recombinant expression of the hyperimmune serum reactive antigens or fragments thereof encoded by the nucleic acid molecule according to the present invention.

The present invention also provides a host cell comprising the vector according to the present invention.

According to another aspect the present invention further provides a hyperimmune serum-reactive antigen comprising an amino acid sequence being encoded by a nucleic acid molecule according to the present invention.

In a preferred embodiment the amino acid sequence (polypeptide) is selected from the group consisting of Seq ID No 171-172, 174-178, 180, 182-188, 190-193, 195-196, 199-213, 215-232, 234-244, 246-247, 249-253, 255-259, 261-262, 264-284, 287-296, 298-316, 318-340, 425, 427, 431-433, 439, 444, 446, 449-451, 459-460, 462-463 and 467-476.

In another preferred embodiment the amino acid sequence (polypeptide) is selected from the group consisting of Seq ID No 173, 179, 181, 194, 197, 214, 233, 245, 254, 285-286, 297, 426, 428-430, 434-438, 440-443, 445, 447-448, 452-458, 461 and 464-466.

In a further preferred embodiment the amino acid sequence (polypeptide) is selected from the group consisting of Seq ID No 260, 317.

According to a further aspect the present invention provides fragments of hyperimmune serum-reactive antigens selected from the group consisting of peptides comprising amino acid sequences of column "predicted immunogenic aa" and "location of identified immunogenic region" of Table 1a and Table 1c; the serum reactive epitopes of Table 2, especially peptides comprising amino acids 4-10, 14-21, 30-36, 59-68, 77-82, 87-93, 96-105, 112-121, 125-133, 135-141, 150-162, 164-183, 192-203, 207-213, 215-226, 228-234, 241-247, 250-285, 302-308 and 135-148 of Seq ID No 171; 15-57, 60-73, 77-101, 108-134, 136-177, 185-201, 203-217, 226-240, 244-254, 272-277, 283-288, 292-343, 354-370, 380-398, 406-437, 439-453, 473-490, 532-538, 584-590, 595-601, 606-612, 664-677, 679-704, 715-724, 731-753, 759-772, 786-794, 814-862 and 657-684 of Seq ID No 172; 4-9, 15-36, 41-47, 54-60, 75-81, 114-120, 131-146, 152-158, 174-182, 194-202, 208-215, 218-226, 255-271, 276-285, 290-295, 302-311, 318-328, 330-344, 352-359, 365-377, 388-395, 398-405, 426-432, 439-449, 455-500, 505-513, 531-537, 542-552, 554-561, 587-595, 606-612, 718-734, 763-771, 775-782, 792-801, 805-812, 822-828, 830-843, 849-863, 876-894, 905-911, 919-926, 935-947, 949-958, 968-979, 1009-1016, 1029-1045, 1047-1056, 1076-1081, 1092-1106, 1123-1133, 1179-1200, 1202-1211, 1215-1223, 1287-1299, 1301-1306, 398-431 and 1224-1237 of Seq ID No 173; 17-47, 74-80, 90-97, 126-133, 137-148, 167-173, 179-185, 214-223, 250-255, 270-283, 329-338, 342-350, 352-358, 360-367, 372-383, 398-404, 411-421, 426-432, 435-446, 452-462, 472-479, 515-521, 582-592, 611-618, 623-629, 642-659, 666-673, 678-689, 704-725, 732-737, 744-757, 768-789, 824-834, 842-849, 862-868, 877-887, 904-916, 923-928, 941-947, 962-974, 982-992, 1019-1030, 1032-1044, 1046-1052, 1065-1075, 1077-1087, 1108-1121, 1124-1132, 1137-1151, 1170-1182, 1190-1206, 1208-1214, 1227-1233, 1242-1251, 1254-1273, 1282-1298 and 792-825 of Seq ID No 174; 19-31, 39-67, 82-91, 104-110, 113-128, 149-155, 161-181 and 137-155 of Seq ID No 175; 6-18, 54-63, 69-85, 110-127, 142-156, 158-167, 169-211, 238-246, 248-257, 276-311, 339-349, 371-380, 385-391, 394-403, 421-438, 451-456, 483-489 and 449-468 of Seq ID No 176; 5-15, 24-34, 50-56, 61-83, 98-121, 123-136, 149-162, 166-194, 202-215, 221-227, 229-332, 337-360, 367-402, 404-415, 427-433, 444-462, 471-478, 487-498, 511-518, 521-544, 550-563, 568-574, 580-587, 597-607, 610-616, 624-629 and 468-498 of Seq ID No 177; 11-19, 32-49, 57-63, 65-71, 80-89, 91-133, 166-181, 183-191, 201-230, 234-257, 264-291, 297-303, 305-314, 316-335, 337-354, 359-366, 368-374, 383-388, 394-405, 408-442, 446-470, 483-490, 499-505, 513-538, 544-555, 557-563, 568-590, 598-608, 617-623, 627-636, 641-647, 667-685, 687-693, 710-723, 733-739, 742-754, 769-815 and 366-388 of Seq ID No 178; 4-16, 30-35, 42-53, 67-76, 82-87, 101-108, 112-130, 132-138, 147-152, 161-183, 187-208, 218-225, 265-281, 295-303, 305-317, 322-334, 338-357, 360-368, 370-383, 387-394, 400-419, 421-430 and 255-336 of Seq ID No 179; 19-27, 36-47, 59-66, 76-83, 101-112, 118-125, 142-147, 162-180, 185-196, 225-240, 246-263, 286-304, 314-319, 327-333, 353-367 and 194-214 of Seq ID No 180; 14-43, 70-76, 83-89, 111-117, 122-128, 136-145, 163-170, 175-182, 210-219, 246-251, 266-279, 325-331, 338-346, 348-354, 356-363, 368-379, 422-428, 431-441, 450-456, 466-473, 509-515, 532-542, 549-556, 576-586, 605-612, 617-623, 636-653, 660-667, 674-686, 698-719, 726-731, 738-745, 762-783, 818-828, 836-843, 856-862, 871-881, 903-910, 917-922, 935-941, 956-968, 976-986, 1013-1024, 1026-1038, 1059-1069, 1071-1081, 1102-1115, 1118-1126, 1131-1145, 1164-1176, 1187-1200, 1202-1208, 1221-1227, 1236-1245, 1248-1267, 1273-1292, 252-287 and 805-844 of Seq ID No 181; 4-18, 21-28, 37-43, 56-70, 101-113, 131-140, 142-150, 162-170, 172-184, 193-204, 209-227, 233-238, 246-264 and 93-168 of Seq ID No 182; 14-20, 44-50, 61-70, 77-96, 99-106, 129-142, 168-181, 187-196, 205-221, 225-241, 277-296 and 257-281 of Seq ID No 183; 18-29, 43-54, 64-76, 78-84, 88-103, 125-149, 159-176, 198-218, 230-242, 256-271, 279-285, 287-293, 300-306, 325-331, 344-351, 357-364, 371-397, 400-414, 419-464, 485-515, 517-526, 529-537, 548-553, 573-580, 584-590, 603-620, 639-661, 676-681, 687-700, 716-761, 772-780, 785-790, 795-803, 823-836, 848-853 and 106-134 of Seq ID No 184; 7-13, 19-42, 44-51, 55-75, 87-97, 99-110, 112-118, 129-135, 141-156, 158-178, 213-220, 230-286, 294-308, 323-338, 345-352, 355-365, 370-392, 394-419, 437-446, 454-460, 474-497, 515-526, 528-546, 569-575 and 128-141 of Seq ID No 185; 12-20, 24-33, 45-70, 73-84, 86-94, 103-116, 118-124, 135-142, 163-170, 176-200, 202-224, 226-234, 237-248, 250-262, 265-287, 296-307, 334-

341, 347-356, 361-369, 382-396, 405-415, 418-427, 431-439, 443-449, 452-461, 467-474 and 113-146 of Seq ID No 186; 13-38, 44-50, 52-59, 66-72, 83-94, 103-110, 116-124, 131-137, 158-180, 199-204, 218-233, 241-264, 269-317, 326-342, 350-356 and 70-86 of Seq ID No 187; 29-35, 49-59, 63-84, 86-97, 103-111, 113-126, 130-144, 150-158, 174-198, 221-231, 250-264, 266-273, 291-298, 310-318 and 70-90 of Seq ID No 188; 19-25, 28-52, 60-66, 71-76, 131-142, 149-155, 157-178, 181-213, 218-223, 237-242, 250-257, 260-266, 272-279, 282-290, 321-330, 373-385, 393-407, 441-453, 461-475, 509-521, 529-542, 577-589, 597-610, 643-655, 663-677, 703-718, 729-734, 358-464, 495-570 and 604-685 of Seq ID No 189; 4-29, 51-76, 116-136, 158-173, 179-193, 207-215 and 86-111 of Seq ID No 190; 5-23, 45-70, 79-90, 93-107, 114-122, 142-151 and 18-36 of Seq ID No 191; 9-51, 68-120, 133-149, 158-180, 186-206, 211-220, 222-237, 248-293, 296-310, 317-339 and 248-260 of Seq ID No 192; 14-24, 44-63, 69-98, 108-119, 123-136, 155-161, 164-176, 180-193, 203-208, 215-223, 239-247, 274-281, 283-289, 296-304, 306-313, 315-327, 331-341, 343-353, 357-386, 392-405 and 205-246 of Seq ID No 193; 5-13, 16-23, 36-42, 53-63, 70-83, 96-102 and 14-34 of Seq ID No 194; 4-13, 19-35, 49-56, 59-76, 83-107, 121-134, 144-153, 157-164, 166-186, 194-202, 209-216, 231-253, 257-264 and 98-134 of Seq ID No 195; 16-32, 38-47, 58-68, 78-89, 98-114, 117-123, 132-141, 146-156, 164-170, 179-188, 196-212, 219-230, 232-237, 244-263, 265-274, 278-293, 297-303, 306-326, 339-349, 352-359, 362-367, 373-379, 384-394, 396-406, 423-443, 451-461, 465-484, 490-497, 504-511, 523-533, 537-547, 550-556, 558-566, 573-579, 586-593, 598-609, 615-642, 647-665, 671-686, 693-713, 723-728 and 332-378 of Seq ID No 196; 6-21, 34-44, 58-64, 66-74, 79-87, 114-127, 129-143, 154-162, 174-189, 205-214, 241-262, 266-273, 278-297, 319-324, 328-338, 342-351, 390-398, 409-415, 422-435, 458-464, 471-477, 481-486, 506-531, 534-540, 542-550 and 315-389 of Seq ID No 197; 4-28, 39-45, 52-58, 69-82, 93-115, 122-128, 135-140, 146-163, 177-192, 209-215, 221-232, 271-284, 331-337, 341-352, 360-378, 383-390, 392-401, 409-422, 428-435, 462-470, 474-480, 482-496, 531-539, 541-549, 551-560, 562-569, 576-582, 598-618 and 98-127 of Seq ID No 198; 14-27, 33-47, 61-79, 94-104, 119-133 and 36-60 of Seq ID No 199; 11-22, 29-40, 48-62, 68-73, 96-106, 108-118, 125-149 and 102-126 of Seq ID No 200; 4-11, 45-55, 76-83, 86-102, 105-112, 138-144, 147-153 and 20-48 of Seq ID No 201; 12-20, 28-56, 62-68, 72-82, 93-99, 101-107, 120-133, 135-145, 178-186, 208-232, 279-292 and 36-64 of Seq ID No 202; 6-14, 23-48, 65-82, 92-134, 140-181, 188-219, 228-238, 244-253, 255-261 and 124-145 of Seq ID No 203; 11-25, 31-38, 53-59, 62-71, 89-99, 125-133, 151-157, 182-190, 195-203, 208-215, 219-229, 249-262, 267-275, 287-295, 298-316, 318-325, 328-334, 344-353, 357-363, 371-377, 385-391, 396-415, 425-436, 438-457, 471-485, 538-552, 554-561, 606-625, 630-636, 646-653, 669-679, 695-704, 706-715, 722-747, 763-773 and 714-738 of Seq ID No 204; 10-29, 33-45, 50-60, 70-79, 83-95, 118-124, 136-157, 176-184, 192-205, 207-216, 223-234, 240-246, 258-268, 275-283 and 37-56 of Seq ID No 205; 4-24, 27-38, 46-54, 66-72, 81-97, 112-119, 128-137, 152-157, 173-179, 185-214, 219-225, 227-248, 262-284, 286-295, 301-307 and 117-134 of Seq ID No 206; 26-43, 49-56, 60-71, 74-82, 87-98, 110-116, 131-146, 154-164, 169-178, 183-189, 205-214, 241-246, 255-268, 275-292, 305-314, 316-323, 326-340, 346-363, 397-402, 419-429, 440-446, 452-461, 467-475 and 29-66 of Seq ID No 207; 7-16, 21-39, 48-58, 61-78, 82-89, 109-136, 138-150, 152-176, 182-247, 255-261, 267-332, 336-345, 347-358, 362-368, 371-392, 394-404, 407-472, 490-498, 505-513, 527-544, 554-582, 603-611, 614-620, 632-638 and 500-523 of Seq ID No 208; 24-46, 77-83, 90-97, 99-118, 123-166, 168-177, 204-212, 229-239, 248-262, 273-282, 287-293, 300-319, 321-337, 340-352, 357-366, 391-402, 411-428, 442-450, 464-471, 479-489 and 19-40 of Seq ID No 209; 9-23, 25-34, 53-58, 70-86, 90-97, 99-116, 118-128, 131-141, 185-191, 228-233, 237-253, 255-261, 264-271, 273-280, 302-312, 319-349, 351-359, 362-369, 376-383, 387-394, 398-406, 419-434 and 20-31 of Seq ID No 210; 15-22, 37-43, 71-87, 105-115, 121-127, 135-142, 152-158 and 32-52 of Seq ID No 211; 6-12, 18-29, 37-47, 50-58, 65-83, 85-91, 94-99, 108-123, 142-150, 156-163, 183-193, 215-222, 242-249, 252-258, 261-270, 285-308, 318-326 and 1-95 of Seq ID No 212; 9-61, 65-133, 144-155, 166-173, 175-221, 233-276, 278-313, 329-368 and 210-233 of Seq ID No 213; 11-29, 33-39, 46-51, 65-93, 107-113, 134-143, 147-154, 166-177, 181-188, 214-220, 233-243, 263-269 and 112-128 of Seq ID No 214; 8-46, 110-134, 155-167, 174-183, 188-201, 210-230, 253-258, 267-282, 289-299, 312-319, 322-327, 330-337, 365-381, 389-402, 405-411, 419-425, 439-447, 465-472, 489-512, 525-532, 540-554, 577-589, 591-599, 605-614, 616-624, 633-649 and 503-529 of Seq ID No 215; 34-49, 64-70, 90-118, 124-131, 141-152, 159-165 and 112-128 of Seq ID No 216; 5-15, 26-45, 55-72, 80-85, 93-100, 121-133, 142-148, 154-167, 198-205, 209-215, 241-254, 260-265, 271-279 and 244-270 of Seq ID No 217; 4-36, 38-54, 67-83, 122-153, 159-178, 205-212, 232-242, 244-253, 259-268, 281-288, 298-309, 324-331, 334-370, 372-381, 389-401, 403-429, 441-450, 456-462, 465-471, 473-479, 483-504, 508-518, 537-543, 553-565, 578-584, 592-609, 619-625, 658-667, 669-679, 712-719, 722-729, 737-744, 746-752, 758-765 and 180-226 of Seq ID No 218; 6-17, 23-32, 49-56, 61-67, 76-83, 85-103, 105-111, 120-132, 145-171, 175-185, 191-225, 231-246 and 99-128 of Seq ID No 219; 4-24, 28-48, 52-58, 64-79, 87-100, 104-120, 136-152, 159-166 and 150-163 of Seq ID No 220; 15-27, 65-71, 77-99, 104-121, 128-154, 183-216, 223-229, 234-255, 277-287, 296-308 and 77-97 of Seq ID No 221; 8-18, 44-76, 102-109 and 49-57 of Seq ID No 222; 5-14, 28-40, 42-51, 54-60, 77-83, 89-100, 117-124, 146-172, 176-204, 216-231, 237-244, 267-278, 324-334, 342-348, 396-401, 427-433, 438-450, 452-457, 465-471, 473-481, 491-500, 509-515, 523-544, 550-556, 558-569, 589-595, 606-618, 625-632, 640-649, 665-671, 678-688, 691-698, 717-723, 728-734, 781-789, 800-805, 812-821, 833-868, 873-879, 889-905, 929-939, 988-998, 1046-1061, 1073-1079, 1089-1096, 1115-1124, 1132-1140, 1172-1196, 1220-1226, 1231-1249, 1269-1277, 1287-1301, 1307-1330, 1350-1361, 1369-1378, 1387-1412, 1414-1420, 1422-1439, 1484-1491, 1513-1529, 1552-1561, 1576-1583, 1606-1613, 1617-1640, 1647-1654, 1665-1679, 1686-1698, 1709-1727, 1736-1743, 1750-1757, 1771-1790, 1801-1807, 1817-1823, 1831-1842, 1859-1868, 1870-1882, 1884-1891, 1900-1906, 1909-1914, 1929-1935, 1952-1960, 1974-1988, 2002-2011, 2032-2063, 2071-2081, 2116-2124, 2139-2147, 2149-2159, 2163-2190, 2209-2215, 2245-2253, 2282-2287, 2331-2342, 2360-2370, 2379-2393, 2402-2408, 2414-2421, 2423-2430, 2433-2439, 2442-2450, 2472-2478, 2485-2493, 2495-2503, 2506-2512, 2547-2554, 2558-2564, 2615-2625, 2637-2652, 2692-2698, 2700-2706, 2711-2723, 2731-2740, 2748-2753, 2756-2762, 2765-2772, 2781-2798, 2810-2824, 2844-2852, 2885-2899, 2912-2922, 2937-2944, 2947-2970, 2988-2998, 3016-3025, 3032-3037, 3062-3071, 3129-3148, 3156-3161 and 530-607 of Seq ID No 223; 31-36, 57-62, 79-85, 90-96, 99-112, 120-146, 162-185, 193-203, 208-217, 219-226, 239-253, 283-290, 298-304, 306-321, 340-349, 351-361, 365-372, 386-395, 407-438, 473-486, 537-551, 558-568, 576-594, 598-604 and 75-95 of Seq ID No 224;

14-19, 24-30, 34-42, 45-52, 54-64, 66-82, 95-105, 107-118, 126-163, 171-177, 184-201, 210-215, 260-269, 273-279, 288-304, 321-327, 358-364, 370-375, 380-387, 394-404, 407-413, 421-431, 436-451, 465-474, 504-511, 531-552, 578-587, 614-626, 629-636, 638-671, 691-715, 719-729, 733-745, 752-759, 768-777, 785-792, 794-802, 805-824, 844-854, 867-880, 885-891, 893-902, 907-924, 939-948, 955-964, 966-975, 987-1000, 1012-1017, 1023-1028, 1050-1071, 1083-1098, 1102-1115, 1133-1146, 1170-1183, 1204-1211, 1213-1223, 1262-1311, 1313-1319, 1346-1355, 1366-1371, 1383-1405, 1409-1414 and 776-819 of Seq ID No 225; 12-27, 30-38, 54-61, 64-74, 82-96, 103-110, 117-125, 134-140, 147-158, 185-201, 218-225, 232-253, 265-280, 319-325, 350-362, 366-372, 376-386, 464-483, 485-490, 511-521, 531-537, 542-559, 564-574, 593-609, 613-619, 637-642, 668-677 and 195-214 of Seq ID No 226; 4-21, 59-67, 73-79, 84-91, 141-151, 186-197, 203-214, 222-227, 237-245, 255-260, 281-292, 294-311, 336-344, 346-355, 422-437, 459-466, 484-491 and 77-109 of Seq ID No 227; 10-45, 52-61, 63-70, 74-102, 112-122, 124-132, 164-178, 181-205, 212-240, 246-256 and 226-247 of Seq ID No 228; 38-50, 53-63, 78-87, 89-111, 126-152, 169-176, 179-186, 193-228, 254-267, 275-282, 288-304, 309-318, 325-341, 346-353, 358-367, 384-395, 404-427, 429-435, 456-465, 467-501, 510-521, 523-536, 541-548, 552-560, 563-584, 589-595, 597-620, 625-637, 639-645, 661-666, 712-729, 734-741, 743-750, 775-806, 809-816, 818-840, 842-850 and 693-714 of Seq ID No 229; 5-17, 30-37, 52-75, 77-86, 88-107, 112-135, 151-160, 178-222, 226-246, 263-270, 279-294, 306-314, 327-342, 345-352, 374-381, 389-416, 422-429, 435-449, 453-467, 473-500, 512-522, 524-531, 542-549, 552-560, 565-571, 575-586, 594-600, 613-619, 625-633, 635-641, 647-653, 667-674, 680-699, 711-729, 735-741, 764-775, 781-786, 792-798, 805-813, 817-825, 833-842, 850-855, 860-866, 869-910, 917-930, 949-990 and 533-562 of Seq ID No 230; 7-14, 39-46, 61-74, 83-89, 93-99, 110-121, 136-150, 172-180, 182-200, 207-216, 223-236, 238-251, 265-271, 280-288, 294-309, 320-336, 339-354, 362-377, 383-389, 401-407, 435-441, 446-453, 460-465, 472-487, 499-511, 518-528, 533-540, 557-570, 572-587, 631-637, 643-658, 663-669, 672-678, 681-687, 695-706, 714-728 and 118-139 of Seq ID No 231; 5-19, 24-30, 56-64, 69-79, 93-100, 102-111, 117-123, 125-133, 174-182, 185-199, 205-224, 268-275, 311-336 and 102-125 of Seq ID No 232; 6-35, 39-45, 57-62, 80-85, 92-106, 117-122, 126-171, 214-223, 253-260, 268-273, 285-291, 295-306, 315-320, 325-336, 361-366 and 172-202 of Seq ID No 233; 4-13, 24-37, 45-51, 58-66, 84-92, 112-121, 132-141, 151-171, 175-195, 204-212, 222-240, 262-268, 276-295, 305-336, 338-348, 354-362 and 160-183 of Seq ID No 234; 10-16, 24-35, 41-73, 78-104, 111-121, 124-139, 141-148, 150-164, 196-215, 224-241, 249-282, 299-307, 315-357, 368-378, 393-401 and 345-367 of Seq ID No 235; 4-32, 48-53, 61-67, 84-104, 112-118 and 106-130 of Seq ID No 236; 21-28, 31-36, 65-81, 98-105, 115-121, 123-131, 136-142, 155-161, 177-190 and 201-232 of Seq ID No 237; 4-15, 21-27, 33-39, 42-56, 58-64, 68-82, 84-90, 92-98, 113-122, 146-162, 168-175, 177-189, 191-203, 249-268, 279-285, 287-304, 328-342, 349-358, 371-378, 387-393, 404-413, 419-425, 467-479, 487-498, 513-524, 528-539, 541-565, 572-579, 595-606, 626-635, 637-642 and 612-626 of Seq ID No 238; 7-13, 52-70, 76-82, 97-106, 110-117 and 13-45 of Seq ID No 239; 5-10, 12-48, 59-64, 87-102, 107-128, 131-140, 154-161, 165-171, 173-215 and 54-74 of Seq ID No 240; 4-11, 19-28, 34-40, 74-81, 87-98, 126-147, 163-171, 184-193, 205-213 and 49-124 of Seq ID No 241; 7-14, 23-29, 35-40, 61-67, 99-106, 111-122, 124-133, 135-161, 187-206, 216-229, 236-245, 262-268, 271-280 and 256-273 of Seq ID No 242; 4-13, 17-37, 47-54, 85-99, 105-113, 120-132, 147-166, 180-186, 192-199, 204-216 and 127-144 of Seq ID No 243; 14-27, 29-37, 52-62, 68-76, 89-96, 117-123, 125-131, 137-145, 166-195, 205-212, 214-222, 228-235, 258-264, 271-281, 288-296, 308-324, 332-339, 355-361, 365-371 and 268-293 of Seq ID No 244; 4-21, 30-42, 54-60, 78-85, 90-110, 141-147, 160-168, 176-185, 194-206, 218-225, 230-245, 251-261, 287-293, 295-304, 320-326, 334-347, 351-362, 386-402, 413-423, 427-433, 439-453, 456-477, 480-493, 507-513, 526-539, 574-581, 591-598, 600-609, 614-632, 655-665, 685-691, 703-712, 742-747, 757-775, 797-803, 813-819, 823-829, 880-887, 901-906, 930-944, 948-958, 962-968, 971-995, 1002-1009, 1017-1023, 1036-1053, 1069-1081, 1107-1124, 1129-1152, 1178-1195, 1211-1223, 1249-1266, 1271-1288, 1334-1340, 1346-1367, 1-63 and 171-189 of Seq ID No 245; 4-22, 52-63, 70-75, 94-104, 112-125, 133-141, 176-199, 209-216, 244-259, 287-299, 336-352, 366-372, 386-399, 421-436, 444-449, 457-466, 481-487, 506-529, 531-540 and 295-378 of Seq ID No 246; 9-30, 43-49, 58-75, 86-96, 119-131, 138-147, 162-167, 181-201, 208-214 and 16-121 of Seq ID No 247; 4-27, 52-58, 80-90, 92-100, 108-114, 118-143, 169-176, 189-198, 247-261, 281-287, 307-317, 323-329, 352-363, 372-381, 396-411, 413-426, 429-440, 442-450, 456-461, 468-479 and 1-73 of Seq ID No 248; 4-32, 47-52, 57-63, 71-78, 92-104, 126-142, 153-175 and 145-163 of Seq ID No 249; 17-23, 35-41, 51-70, 73-86, 104-125 and 105-129 of Seq ID No 250; 25-32, 41-50, 75-85, 87-103, 115-122, 138-149, 164-171, 188-210, 212-220, 224-234, 256-273, 288-299, 304-310, 330-336, 357-365, 382-390, 399-405, 414-421, 440-446, 454-461, 480-486, 502-514, 518-540, 543-553, 561-567, 572-580, 582-588, 595-630, 633-651, 672-681, 691-709, 760-767, 813-832, 841-848, 852-866, 873-893, 919-925, 927-933, 940-955, 957-978, 984-997, 1000-1010, 1035-1040, 1044-1051, 1058-1064, 1081-1091, 1097-1124, 1129-1138, 1144-1150, 1158-1165, 1170-1180, 909-936 and 1001-1031 of Seq ID No 251; 4-12, 19-26, 31-41, 49-64, 66-86, 101-117, 119-127, 134-142, 152-161, 163-172, 179-188, 209-218, 234-241, 276-291, 294-300, 307-320, 324-341, 346-356, 373-387, 389-397, 410-416, 418-436, 444-454, 460-472, 481-486, 500-507, 511-535, 541-549, 553-559, 579-586, 602-607, 613-620, 628-640, 654-663, 671-678, 681-691, 709-722, 741-754, 766-774, 778-786, 797-803 and 212-226 of Seq ID No 252; 4-10, 15-27, 34-54, 60-73, 79-88, 101-115, 120-136, 154-162, 167-172, 222-240 and 126-195 of Seq ID No 253; 5-16, 18-25, 29-35, 57-63, 86-91, 107-121, 123-131, 170-179, 185-199, 204-226, 250-255, 262-274, 291-296, 325-347 and 1-38 of Seq ID No 254; 7-19, 22-34, 36-42, 48-54, 60-66, 71-76, 104-110, 118-133, 135-145, 158-164, 167-174, 182-193, 196-204, 217-229, 251-290, 293-299, 309-315 and 288-318 of Seq ID No 255; 43-51, 55-61, 66-73, 80-90, 103-127, 133-142, 174-180, 185-196, 203-210, 229-235, 239-251, 258-266, 272-278, 289-314, 316-326, 340-346, 355-361 and 14-27 of Seq ID No 256; 4-25, 27-33, 35-41, 52-74, 76-89, 99-124, 138-144, 146-159, 167-182, 184-191, 193-206, 211-223, 232-240, 249-257, 270-279, 281-287, 293-310, 322-341, 347-356 and 292-322 of Seq ID No 257; 5-13, 28-38, 43-60, 67-72, 98-116, 122-134, 137-151, 167-174, 177-195, 197-216 and 99-195 of Seq ID No 258; 15-33, 35-42, 48-57, 62-68, 73-91, 107-119, 121-153, 173-194, 205-210, 223-228, 234-241, 243-259, 275-298, 308-315, 327-340, 342-370, 376-391, 398-404, 410-419 and 71-122 of Seq ID No 259; 12-39, 43-64, 87-95, 99-105, 114-126, 128-136, 139-147, 212-225 and 107-141 of Seq ID No 260; 6-33, 40-45, 60-75, 79-86, 121-129, 131-137, 161-167, 172-178, 186-195, 203-212, 236-244, 257-264, 278-294, 306-312, 345-358, 368-381, 386-395, 404-410, 412-418 and 198-270 of Seq ID No 261; 18-31, 34-41, 50-56, 69-83, 99-106, 129-141, 147-153, 159-168, 170-178, 190-198, 200-212, 221-232, 237-255, 261-266, 274-292 and 118-216 of Seq ID No 262; 17-47, 61-67, 87-93, 115-121, 126-132, 140-148, 167-173, 179-186, 214-223, 250-255, 264-272, 282-294, 306-318, 338-353, 358-377, 385-401, 414-420, 433-441, 451-457, 470-480, 505-511, 544-550, 571-581, 600-607, 612-618, 631-648, 655-662, 669-681, 693-714, 721-726, 733-740, 757-778, 813-823, 831-838, 851-857, 866-876, 893-905, 912-917, 930-936, 951-963, 971-981, 1008-1019, 1021-1033, 1035-1041, 1054-1064, 1066-1076, 1097-1110, 1113-1121, 1126-1140, 1159-1171, 1182-1195, 1197-1203, 1216-1222, 1231-1240, 1243-1262, 1268-1287 and 738-828 of Seq ID No 263; 19-28, 40-46, 51-57, 68-74, 81-87, 98-108, 111-121 and 20-36 of Seq ID No 264; 4-17, 19-44, 60-69, 80-86, 110-116 and 33-60 of Seq ID No 265; 8-16, 18-28, 42-50, 53-75, 79-86, 94-99, 122-128, 136-142, 149-163, 166-173, 198-212, 254-272, 288-295, 304-318, 324-329, 343-348, 351-364, 367-383, 389-395, 411-420, 427-436 and 11-56 of Seq ID No 266; 19-25 and 6-24 of Seq ID No 267; 6-39, 59-68 and 44-63 of Seq ID No 268; 5-14, 21-28, 38-53 and 29-41 of Seq ID No 269; 4-13, 31-41, 56-65 and 32-56 of Seq ID No 270; 5-12 and 4-21 of Seq ID No 271; 4-18 and 17-32 of Seq ID No 272; 4-10, 23-33 and 14-30 of Seq ID No 273; 26-34, 44-53 and 35-52 of Seq ID No 274; 1-19 of Seq ID No 275; 4-17, 23-30, 32-37 and 6-23 of Seq ID No 276; 5-33, 40-58, 61-66 and 45-66 of Seq ID No 277; 15-41, 61-67 and 41-65 of Seq ID No 278; 4-12, 16-23, 26-37 and 10-29 of Seq ID No 279; 23-39 and 37-55 of Seq ID No 280; 12-20 and 38-55 of Seq ID No 281; 22-37 and 7-22 of Seq ID No 282; 3-14 of Seq ID No 283; 6-16, 43-65, 71-76 and 17-31 of Seq ID No 284; 4-13, 27-39, 42-69 and 17-32 of Seq ID No 285; 4-12, 26-39 and 10-25 of Seq ID No 286; 2-31 of Seq ID No 287; 6-38, 49-62 and 39-55 of Seq ID No 288; 4-10, 24-30 and 2-19 of Seq ID No 289; 12-17, 25-46 and 15-30 of Seq ID No 290; 4-13 and 2-28 of Seq ID No 291; 30-38 and 17-45 of Seq ID No 292; 24-33, 55-61 and 31-61 of Seq ID No 293; 4-26, 34-48 and 15-33 of Seq ID No 294; 9-15 and 1-22 of Seq ID No 295; 4-31 and 14-33 of Seq ID No 296; 5-34, 49-55, 64-82 and 69-83 of Seq ID No 297; 33-45 and 21-39 of Seq ID No 298; 7-14, 24-32, 42-65, 79-86 and 50-64 of Seq ID No 299; 13-27, 33-43, 45-62 and 12-37 of Seq ID No 300; 4-15, 17-32 and 10-26 of Seq ID No 301; 4-9, 11-43, 45-75 and 47-69 of Seq ID No 302; 4-18, 22-37 and 17-34 of Seq ID No 303; 4-14 and 5-24 of Seq ID No 304; 7-33, 35-46 and 1-19 of Seq ID No 305; 13-37, 69-75 and 51-69 of Seq ID No 306; 14-24, 26-34, 37-49, 66-78 and 2-25 of Seq ID No 307; 17-46, 52-57, 59-64 and 54-68 of Seq ID No 308; 4-22 and 13-25 of Seq ID No 309; 8-40, 53-63 and 29-50 of Seq ID No 310; 16-28 and 32-40 of Seq ID No 311; 14-20, 22-28, 39-45 and 2-22 of Seq ID No 312; 4-13 and 12-31 of Seq ID No 313; 15-21 and 2-17 of Seq ID No 314; 4-17 and 20-36 of Seq ID No 315; 4-19 and 9-18 of Seq ID No 316; 4-14 and 3-19 of Seq ID No 317; 4-21, 32-40 and 21-39 of Seq ID No 318; 4-13 and 10-27 of Seq ID No 319; 18-31, 39-47, 75-87, 89-98 and 79-99 of Seq ID No 320; 15-21 and 9-24 of Seq ID No 321; 4-14, 18-27, 30-53, 55-64, 68-74, 81-98 and 22-40 of Seq ID No 322; 7-24, 44-51 and 35-60 of Seq ID No 323; 10-47 and 23-37 of Seq ID No 324; 4-10, 12-46 and 7-22 of Seq ID No 325; 20-27 and 1-13 of Seq ID No 326; 6-19, 41-51 and 9-37 of Seq ID No 327; 4-9, 11-17 and 9-23 of Seq ID No 328; 4-17, 23-38, 46-66, 68-85 and 34-46 of Seq ID No 329; 4-18, 34-59, 75-81 and 61-84 of Seq ID No 330; 6-17 and 7-28 of Seq ID No 331; 4-32, 56-61 and 35-52 of Seq ID No 332; 4-14, 27-71, 74-88, 93-110, 115-120, 124-130, 139-154, 161-172 and 146-171 of Seq ID No 333; 4-21 and 3-15 of Seq ID No 334; 12-17 and 9-26 of Seq ID No 335; 10-21, 45-58 and 51-67 of Seq ID No 336; 59-66, 68-84 and 13-42 of Seq ID No 337; 11-16 and 1-16 of Seq ID No 338; 4-19, 23-37 and 10-30 of Seq ID No 339; 19-27, 35-46, 48-66, 82-88, 99-105, 113-119 and 42-59 of Seq ID No 340; 135-147 of Seq ID No 171; 658-682 of Seq ID No 172; 411-427 and 1226-1246 of Seq ID No 173; 794-817 and 801-824 of Seq ID No 174; 468-492 and 474-495 of Seq ID No 177; 366-388 of Seq ID No 178; 266-291, 287-312 and 308-333 of Seq ID No 179; 197-213 and 195-211 of Seq ID No 180; 252-275, 262-285 and 812-830 of Seq ID No 181; 94-112, 97-120 and 104-128 of Seq ID No 182; 257-281 of Seq ID No 183; 106-134 of Seq ID No 184; 70-86 of Seq ID No 187; 358-383, 378-402, 397-421, 499-524, 520-545, 541-566, 622-646, 641-665 and 660-684 of Seq ID No 189; 248-260 of Seq ID No 192; 15-34 of Seq ID No 194; 112-129 of Seq ID No 195; 333-358 and 353-378 of Seq ID No 196; 316-343, 339-366 and 362-389 of Seq ID No 197; 98-123 and 104-126 of Seq ID No 198; 20-43 and 23-48 of Seq ID No 201; 124-145 of Seq ID No 203; 717-738 of Seq ID No 204; 37-56 of Seq ID No 205; 118-134 of Seq ID No 206; 500-522 of Seq ID No 208; 32-47 of Seq ID No 211; 25-51, 47-73 and 69-95 of Seq ID No 212; 503-529 of Seq ID No 215; 112-128 of Seq ID No 216; 181-199 of Seq ID No 218; 109-121 of Seq ID No 219; 150-163 of Seq ID No 220; 77-97 of Seq ID No 221; 564-586 of Seq ID No 223; 75-94 of Seq ID No 224; 776-798, 784-808 and 794-815 of Seq ID No 225; 196-212, 78-100 and 85-107 of Seq ID No 226; 536-553 of Seq ID No 230; 102-125 of Seq ID No 232; 178-198 of Seq ID No 233; 612-626 of Seq ID No 238; 171-187 of Seq ID No 245; 296-320, 315-339, 334-358 and 353-377 of Seq ID No 246; 47-71 of Seq ID No 247; 1-25, 20-45 and 40-64 of Seq ID No 248; 146-161 of Seq ID No 249; 910-935 and 1007-1030 of Seq ID No 251; 212-226 of Seq ID No 252; 126-152, 148-173 and 169-195 of Seq ID No 253; 288-310 and 293-316 of Seq ID No 255; 293-312 of Seq ID No 257; 154-170 of Seq ID No 258; 72-95, 90-112 and 97-121 of Seq ID No 259; 135-150 and 146-163 of Seq ID No 262; 799-827 of Seq ID No 263; 23-43 and 33-53 of Seq ID No 266; 44-62 of Seq ID No 268; 6-22 of Seq ID No 276; 37-54 of Seq ID No 280; 40-54 of Seq ID No 281; 7-21 of Seq ID No 282; 4-11, 16-34, 48-55, 67-77, 87-106 and 153-183 of Seq ID No 425; 22-40, 49-65, 70-91, 95-109, 111-125, 146-207, 209-216, 219-225, 229-244, 251-270, 274-286, 292-309, 316-329, 335-355, 358-370, 376-388, 392-419, 425-430, 435-441, 448-455, 464-478, 486-515 and 437-465 of Seq ID No 426; 5-19, 25-31, 43-48, 60-79, 88-100, 105-129, 148-171, 187-193, 243-263, 316-322, 334-340, 345-351, 369-378, 381-391, 399-404, 474-483, 502-517, 525-530, 558-568, 579-596, 622-627, 631-638, 644-651, 653-660, 674-680, 687-693, 721-728, 743-753, 760-775, 788-795, 806-813, 821-828, 835-842, 847-859, 868-887 and 300-347 of Seq ID No 427; 5-26, 37-44, 89-97, 112-118, 121-128, 138-154, 157-165, 176-181, 188-198, 205-218, 223-243, 247-253, 260-279 and 76-155 of Seq ID No 428; 4-29, 41-46, 49-68, 82-88, 121-147, 158-164, 187-193, 195-208, 229-236, 244-249, 251-263, 269-275, 307-313, 337-343, 348-381, 392-398, 402-408, 432-438, 85-117 and 194-239 of Seq ID No 429; 5-12, 14-22, 28-34, 40-46, 70-79, 84-129, 152-165, 174-182 and 37-109 of Seq ID No 430; 5-16, 18-52, 54-72, 81-86, 118-126, 136-145, 151-157, 168-180, 209-233, 244-270, 295-302, 315-326, 329-337, 345-352, 364-373, 397-402, 408-418, 424-431, 435-443, 472-480, 483-489, 504-510, 519-527, 549-564, 576-599, 605-637, 641-673 and 91-98 of Seq ID No 431; 23-36, 42-52, 133-140, 151-157, 242-247, 267-277, 295-301, 320-328, 333-339, 345-352, 365-371, 397-403, 415-428, 456-465, 481-487, 489-495, 508-516, 518-527, 585-592, 606-614, 631-637, 643-658, 665-670, 723-728, 737-744, 752-759, 787-793, 835-841, 873-885, 918-928, 938-945, 951-966, 978-988, 1015-1020, 1030-1036, 1044-1052, 1058-1069, 1071-1079, 1081-1088, 1113-1119, 1125-1138, 1141-1147, 1164-1170, 1172-1177, 1190-1200, 1214-1220, 1230-1236, 1239-1245, 1262-1268, 1270-1275, 1288-1298, 1312-1318, 1328-1334, 1337-1343, 1360-1366, 1368-1373, 1386-1396, 1410-1416, 1426-1432, 1435-1441, 1458-1464, 1466-1471, 1484-1494, 1508-1514, 1524-1530, 1533-1539, 1556-1562 and 307-340 of Seq ID No 432; 19-25, 35-41, 44-50, 66-72, 74-79, 92-102, 116-122, 132-138, 141-147, 164-170, 172-177, 190-200, 214-220, 230-236, 239-245, 262-268, 270-275, 288-298, 312-318, 328-334, 337-343, 360-366, 368-373, 386-396, 410-416, 426-432, 435-441, 458-464, 466-478, 504-524, 79-148, 177-246, 275-344 and 373-442 of Seq ID No 433; 7-14, 16-23, 33-39, 46-53, 72-79, 92-115, 123-130, 156-175, 179-187, 214-220, 239-246, 266-274, 302-325, 338-354, 360-370, 375-390, 392-401, 421-428, 430-463 and 29-58 of Seq ID No 434; 4-9, 22-39, 58-65, 72-82, 87-92, 99-104, 107-119, 143-166, 171-177, 194-202, 205-213, 220-228, 231-240, 247-263, 309-315, 317-323, 336-343 and 294-320 of Seq ID No 435; 4-10, 12-18, 24-29, 34-43, 50-65, 70-76, 111-117, 129-138, 152-159, 166-171, 184-195, 200-210, 224-236, 241-251, 274-283, 285-296, 313-319, 332-341, 348-355, 378-386, 410-416, 433-445, 475-482, 523-529, 531-540, 584-596, 626-633, 674-680, 682-688, 738-750, 780-787, 828-834, 836-842, 853-862, 882-887, 893-912 and 604-676 of Seq ID No 436; 15-38, 49-57, 60-99, 103-119, 124-194, 200-206, 215-249, 251-291, 307-313, 315-347, 369-378, 383-390, 393-400, 405-411, 423-435, 440-447, 454-460, 470-486, 490-503, 532-539, 542-549, 551-567, 579-592 and 509-583 of Seq ID No 437; 38-44, 47-88, 95-103, 157-172, 235-240, 250-260, 263-276, 294-300, 312-317, 331-337, 369-391, 412-419, 442-448, 453-463, 490-529, 537-555, 571-580, 600-617, 619-627, 642-648, 682-687, 693-700, 716-722, 738-748, 756-763, 779-789, 796-802, 820-828, 833-840, 846-853, 862-872, 880-887, 894-899, 924-937, 957-963, 1006-1012, 1043-1049, 1063-1069, 1076-1097 and 124-147 of Seq ID No 438; 4-28, 31-49, 60-71, 75-102, 104-114, 134-144, 160-184, 250-257, 277-285, 287-294, 330-338, 345-351, 367-374, 381-388, 393-399, 402-407, 420-426, 443-448, 458-464, 411-436 and 454-488 of Seq ID No 439; 20-27, 45-55, 57-64, 66-77, 98-106, 130-137, 155-165, 167-174, 176-187, 194-203, 208-223, 227-238, 245-251, 257-270, 273-278, 287-299, 330-345, 352-358, 363-385, 392-399, 410-417, 437-443, 467-484, 486-492, 495-500, 504-516, 526-536 and 219-270 of Seq ID No 440; 11-22, 24-31, 46-63, 65-71, 73-88, 95-109, 174-181, 183-201, 204-212, 216-222, 228-233, 241-247 and 142-221 of Seq ID No 441; 8-28, 51-59, 67-84, 93-98, 140-152, 154-162, 183-188 and 91-125 of Seq ID No 442; 10-22, 27-61 and 69-100 of Seq ID No 443; 7-15, 18-26, 94-100, 126-131, 152-165, 219-228, 254-263, 274-292, 297-308, 333-340, 342-352, 354-371, 373-379, 403-410, 420-438, 450-456, 463-470, 489-495, 503-512 and 97-173 of Seq ID No 444; 4-21, 37-43, 49-65, 67-74, 76-90, 113-119, 131-141, 155-173, 175-189, 192-199, 207-221, 247-254, 266-276, 317-322, 337-343, 387-393, 408-428, 439-448, 451-460, 469-479, 482-487, 493-501, 517-523, 533-542 and 480-503 of Seq ID No 445; 11-26, 40-46, 78-86, 93-103, 121-126, 132-138, 166-177, 183-196, 203-212, 214-221, 228-263, 304-311, 323-338, 345-351, 357-363, 379-393, 420-434, 442-448, 518-527, 547-553, 581-591, 602-609, 637-645, 665-674, 687-692, 701-708, 730-739, 796-802, 844-857, 882-888, 903-914, 944-950, 976-983, 1027-1033, 1049-1057, 1066-1072, 1085-1092, 1120-1127, 1137-1144, 1153-1158, 1165-1176, 1181-1187, 1221-1230, 1238-1244, 1269-1274 and 605-632 of Seq ID No 446; 6-47, 57-65, 83-95, 109-121, 138-147, 154-164, 167-177, 194-200, 202-212, 227-234, 240-253, 260-267, 283-291, 320-329, 340-347, 356-364, 412-422, 430-436, 441-459, 465-475, 478-486, 498-507 and 59-84 of Seq ID No 447; 10-21, 58-83, 88-97, 120-126 and 21-51 of Seq ID No 448; 5-39, 56-62, 76-88, 90-114, 138-162, 170-195, 202-221, 228-250, 264-270, 304-355, 374-387, 391-416, 462-471, 526-546, 554-561, 574-579, 639-645, 651-660, 674-682, 689-694 and 666-697 of Seq ID No 449; 6-30, 36-42, 143-157, 176-197, 202-209, 216-233, 241-246, 275-287, 292-299, 315-325, 343-350, 375-380, 397-403, 411-420, 422-434, 441-448, 467-474, 477-499, 555-568, 591-597, 601-609, 623-644, 667-688, 692-698, 703-718, 736-747, 757-766, 782-791, 795-801, 832-840, 859-865 and 226-269 of Seq ID No 450; 6-23, 43-51, 61-67, 73-82, 91-97, 123-130, 149-158, 164-175, 228-234, 240-246, 248-255, 262-272, 326-332, 340-347, 365-371, 377-388, 409-419, 425-431, 438-445, 449-457, 464-470, 496-507, 559-568, 575-581, 603-608, 617-623, 633-639, 648-654, 659-670, 695-701, 734-752, 806-814, 816-829, 861-868, 891-899, 904-909, 937-945, 947-960, 978-983, 992-999, 1022-1031, 1068-1076, 1078-1091, 1109-1114, 1123-1130, 1153-1162, 1199-1207, 1209-1222, 1254-1261, 1284-1293, 1330-1338, 1340-1353, 1371-1376, 1385-1392, 1415-1421, 1433-1438, 1460-1465, 1470-1492 and 1422-1458 of Seq ID No 451; 82-94, 111-118, 125-131, 206-212, 261-266, 310-320, 328-338, 345-351, 353-360, 414-420, 424-434, 440-447, 451-500, 506-516, 548-561, 566-572, 584-591, 601-622, 630-636, 650-659, 661-667, 674-699, 703-711, 717-729, 736-744, 752-759, 765-771, 813-822, 826-842, 852-868, 870-877, 881-895, 897-906, 913-922 and 602-671 of Seq ID No 452; 12-18, 20-25, 43-54, 56-65, 73-79, 82-88, 99-111, 136-142, 153-169, 171-183, 195-223, 229-248, 255-260, 272-277, 281-292, 298-319, 322-329, 332-351, 363-379, 381-389 and 275-304 of Seq ID No 453; 4-9, 34-48, 65-77, 101-106, 111-131, 138-153, 186-191, 230-250 and 148-219 of Seq ID No 454; 4-23, 30-35, 42-53, 67-76, 82-87, 101-108, 112-130, 132-138, 147-152, 161-183, 187-208, 218-225, 265-283, 295-303, 306-317, 322-334, 338-357, 360-368, 370-383, 387-398, 400-419, 421-430, 104-182 and 240-304 of Seq ID No 455; 4-12, 63-69, 94-102, 146-164, 166-173, 175-181, 193-207, 263-281, 286-295, 301-306, 330-343, 369-378, 382-388, 414-420, 422-430, 438-454, 456-462, 472-531, 543-560, 581-591, 596-605, 614-623, 626-635, 656-662, 669-676, 683-690, 693-698, 705-711, 728-736, 752-764 and 69-102 of Seq ID No 456; 6-12, 43-53, 141-147, 164-179, 185-195, 197-206, 227-235, 237-271, 288-305, 308-317, 335-341, 351-357, 365-376, 386-395, 397-416, 422-447 and 11-35 of Seq ID No 457; 16-24, 50-65, 73-84, 88-99, 114-124, 130-146, 181-187, 193-203, 214-220, 236-247, 250-258, 287-297 and 50-113 of Seq ID No 458; 4-25, 50-55, 76-82, 117-123, 131-137, 139-148, 157-166, 239-245, 253-258, 266-275, 277-292, 300-306, 51-83 and 93-161 of Seq ID No 459; 6-22, 34-43, 51-86, 93-100, 110-116, 150-161, 164-171, 180-187, 197-218 and 168-237 of Seq ID No 460; 4-27, 55-60, 74-82 and 10-46 of Seq ID No 461; 6-19, 25-31, 43-49, 60-79, 88-100, 105-129, 148-161, 164-171, 187-193, 243-263, 316-322, 334-340, 369-378, 381-391, 398-404, 460-466, 474-483, 502-509, 511-517, 525-530, 558-567, 579-596, 622-627, 631-638, 641-651, 653-659, 674-680, 687-693, 710-716, 720-727, 743-753, 760-775, 788-795, 806-813, 821-828, 836-842, 847-860, 865-880 and 258-377 of Seq ID No 462; 4-11, 25-64, 71-79, 88-94, 107-120, 123-132, 167-188, 231-237, 240-246, 261-267, 306-311, 330-342, 351-358, 389-395, 406-418, 429-434, 439-448, 483-501, 511-520 and 71-143 of Seq ID No 463; 4-18, 22-27, 53-64, 94-100, 121-127, 133-139, 155-164, 177-182, 187-196, 206-218, 224-242, 248-253, 258-277 and 184-253 of Seq ID No 464; 10-17, 56-67, 72-82, 94-99, 106-113, 166-173, 229-235, 243-283, 295-301, 313-321, 326-331, 342-348, 396-414, 423-435, 446-452, 454-462, 496-502, 511-534, 543-556, 563-570, 586-593, 616-626, 638-645, 653-662, 679-696, 731-737, 766-774, 776-782, 790-796, 810-817, 825-835, 837-846 and 540-615 of Seq ID No 465; 13-24, 30-36, 73-81, 89-95, 109-115, 117-143, 161-173, 179-189, 226-244, 251-261, 275-281, 298-305, 307-315, 323-328, 364-374, 69-186 and 264-354 of Seq ID No 466; 19-25 and 6-22 of Seq ID No 467; 6-39, 59-68 and 43-62 of Seq ID No 468; 6-14, 22-32 and 1-27 of Seq ID No 469; 4-41 and 28-40 of Seq ID No 470; 8-14 and 4-19 of Seq ID No 471; 4-10, 12-22, 30-35 and 6-33 of Seq ID No 472; 4-16, 24-33 and 37-54 of Seq ID No 473; 2-23 of Seq ID No 474; 4-21, 27-33, 36-41 and 14-34 of Seq ID No 475; 4-14, 24-30, 37-42, 57-78, 83-89, 94-103, 113-131 and 100-122 of Seq ID No 476.

The present invention also provides a process for producing a E. faecalis hyperimmune serum reactive antigen or a fragment thereof according to the present invention comprising expressing one or more of the nucleic acid molecules according to the present invention in a suitable expression system.

Moreover, the present invention provides a process for producing a cell, which expresses a E. faecalis hyperimmune serum reactive antigen or a fragment thereof according to the present invention comprising transforming or transfecting a suitable host cell with the vector according to the present invention.

According to the present invention a pharmaceutical composition, especially a vaccine, comprising a hyperimmune serum-reactive antigen or a fragment thereof as defined in the present invention or a nucleic acid molecule as defined in the present invention is provided.

In a preferred embodiment the pharmaceutical composition further comprises an immunostimulatory substance, preferably selected from the group comprising polycationic polymers, especially polycationic peptides, immunostimulatory deoxynucleotides (ODNs), peptides containing at least two LysLeuLys motifs, especially KLKL$_5$KLK (SEQ ID NO:479), neuroactive compounds, especially human growth hormone, alumn, Freund's complete or incomplete adjuvants or combinations thereof.

In a more preferred embodiment the immunostimulatory substance is a combination of either a polycationic polymer and immunostimulatory deoxynucleotides or of a peptide containing at least two LysLeuLys motifs and immunostimulatory deoxynucleotides.

In a still more preferred embodiment the polycationic polymer is a polycationic peptide, especially polyarginine.

According to the present invention the use of a nucleic acid molecule according to the present invention or a hyperimmune serum-reactive antigen or fragment thereof according to the present invention for the manufacture of a pharmaceutical preparation, especially for the manufacture of a vaccine against enterococcal infection, is provided.

Also an antibody, or at least an effective part thereof, which binds at least to a selective part of the hyperimmune serum-reactive antigen or a fragment thereof according to the present invention is provided herewith.

In a preferred embodiment the antibody is a monoclonal antibody.

In another preferred embodiment the effective part of the antibody comprises Fab fragments.

In a further preferred embodiment the antibody is a chimeric antibody.

In a still preferred embodiment the antibody is a humanized antibody.

The present invention also provides a hybridoma cell line, which produces an antibody according to the present invention.

Moreover, the present invention provides a method for producing an antibody according to the present invention, characterized by the following steps:
  initiating an immune response in a non-human animal by administrating an hyperimmune serum-reactive antigen or a fragment thereof, as defined in the invention, to said animal,
  removing an antibody containing body fluid from said animal, and
  producing the antibody by subjecting said antibody containing body fluid to further purification steps.

Accordingly, the present invention also provides a method for producing an antibody according to the present invention, characterized by the following steps:
  initiating an immune response in a non-human animal by administrating an hyperimmune serum-reactive antigen or a fragment thereof, as defined in the present invention, to said animal,
  removing the spleen or spleen cells from said animal,
  producing hybridoma cells of said spleen or spleen cells,
  selecting and cloning hybridoma cells specific for said hyperimmune serum-reactive antigens or a fragment thereof,
  producing the antibody by cultivation of said cloned hybridoma cells and optionally further purification steps.

The antibodies provided or produced according to the above methods may be used for the preparation of a medicament for treating or preventing enterococcal infections.

According to another aspect the present invention provides an antagonist which binds to a hyperimmune serum-reactive antigen or a fragment thereof according to the present invention.

Such an antagonist capable of binding to a hyperimmune serum-reactive antigen or fragment thereof according to the present invention may be identified by a method comprising the following steps:
  a) contacting an isolated or immobilized hyperimmune serum-reactive antigen or a fragment thereof according to the present invention with a candidate antagonist under conditions to permit binding of said candidate antagonist to said hyperimmune serum-reactive antigen or fragment, in the presence of a component capable of providing a detectable signal in response to the binding of the candidate antagonist to said hyperimmune serum reactive antigen or fragment thereof; and
  b) detecting the presence or absence of a signal generated in response to the binding of the antagonist to the hyperimmune serum reactive antigen or the fragment thereof.

An antagonist capable of reducing or inhibiting the interaction activity of a hyperimmune serum-reactive antigen or a fragment thereof according to the present invention to its interaction partner may be identified by a method comprising the following steps:
  a) providing a hyperimmune serum reactive antigen or a hyperimmune fragment thereof according to the present invention,
  b) providing an interaction partner to said hyperimmune serum reactive antigen or a fragment thereof, especially an antibody according to the present invention,
  c) allowing interaction of said hyperimmune serum reactive antigen or fragment thereof to said interaction partner to form an interaction complex,
  d) providing a candidate antagonist, e) allowing a competition reaction to occur between the candidate antagonist and the interaction complex, f) determining whether the candidate antagonist inhibits or reduces the interaction activities of the hyperimmune serum reactive antigen or the fragment thereof with the interaction partner.

The hyperimmune serum reactive antigens or fragments thereof according to the present invention may be used for the isolation and/or purification and/or identification of an interaction partner of said hyperimmune serum reactive antigen or fragment thereof.

The present invention also provides a process for in vitro diagnosing a disease related to expression of a hyperimmune serum-reactive antigen or a fragment thereof according to the present invention comprising determining the presence of a nucleic acid sequence encoding said hyperimmune serum reactive antigen or fragment thereof according to the present invention or the presence of the hyperimmune serum reactive antigen or fragment thereof according to the present invention.

The present invention also provides a process for in vitro diagnosis of a bacterial infection, especially a enterococcal infection, comprising analyzing for the presence of a nucleic acid sequence encoding said hyperimmune serum reactive antigen or fragment thereof according to the present invention or the presence of the hyperimmune serum reactive antigen or fragment thereof according to the present invention.

Moreover, the present invention provides the use of a hyperimmune serum reactive antigen or fragment thereof according to the present invention for the generation of a peptide binding to said hyperimmune serum reactive antigen or fragment thereof, wherein the peptide is an anticaline.

The present invention also provides the use of a hyperimmune serum-reactive antigen or fragment thereof according to the present invention for the manufacture of a functional nucleic acid, wherein the functional nucleic acid is selected from the group comprising aptamers and spiegelmers.

The nucleic acid molecule according to the present invention may also be used for the manufacture of a functional ribonucleic acid, wherein the functional ribonucleic acid is selected from the group comprising ribozymes, antisense nucleic acids and siRNA.

The present invention advantageously provides an efficient, relevant and comprehensive set of isolated nucleic acid molecules and their encoded hyperimmune serum reactive antigens or fragments thereof identified from *E. faecalis* using an antibody preparation from multiple human plasma pools and surface expression libraries derived from the genome of *E. faecalis*. Thus, the present invention fulfils a widely felt demand for *E. faecalis* antigens, vaccines, diagnostics and products useful in procedures for preparing antibodies and for identifying compounds effective against enterococcal infections.

An effective vaccine should be composed of proteins or polypeptides, which are expressed by all strains and are able to induce high affinity, abundant antibodies against cell surface components of *E. faecalis*. The antibodies should be IgG1 and/or IgG3 for opsonization, and any IgG subtype and IgA for neutralisation of adherence and toxin action. A chemically defined vaccine must be definitely superior compared to a whole cell vaccine (attenuated or killed), since components of *E. faecalis*, which cross-react with human tissues or inhibit opsonization {Whitnack, E. et al., 1985} can be eliminated, and the individual proteins inducing protective antibodies and/or a protective immune response can be selected.

The approach, which has been employed for the present invention, is based on the interaction of enterococcal proteins or peptides with the antibodies present in human sera. The antibodies produced against *E. faecalis* by the human immune system and present in human sera are indicative of the in vivo expression of the antigenic proteins and their immunogenicity. In addition, the antigenic proteins as identified by the bacterial surface display expression libraries using pools of pre-selected sera, are processed in a second and third round of screening by individual selected or generated sera. Thus the present invention supplies an efficient, relevant, comprehensive set of enterococcal antigens as a pharmaceutical composition, especially a vaccine preventing infection by *E. faecalis*.

In the antigen identification program for identifying a comprehensive set of antigens according to the present invention, at least two different bacterial surface expression libraries are screened with several serum pools or plasma fractions or other pooled antibody containing body fluids (antibody pools). The antibody pools are derived from a serum collection, which has been tested against antigenic compounds of *E. faecalis*, such as whole cell extracts and culture supernatant proteins. Preferably, 2 distinct serum collections are used: 1. With very stable antibody repertoire: normal adults, clinically healthy people, who are non-carriers and overcame previous encounters or currently carriers of *E. faecalis* without acute disease and symptoms, 2. With antibodies induced acutely by the presence of the pathogenic organism: patients with acute disease with different manifestations (e.g. *E. faecalis* endocarditis, urinary tract infection and bacteremia). Sera have to react with multiple enterococci-specific antigens in order to be considered hyperimmune and therefore relevant in the screening method applied for the present invention. The antibodies produced against enterococci by the human immune system and present in human sera are indicative of the in vivo expression of the antigenic proteins and their immunogenicity.

The expression libraries as used in the present invention should allow expression of all potential antigens, e.g. derived from all surface proteins of *E. faecalis*. Bacterial surface display libraries will be represented by a recombinant library of a bacterial host displaying a (total) set of expressed peptide sequences of enterococci on a number of selected outer membrane proteins (LamB, BtuB, FhuA) at the bacterial host membrane {Georgiou, G., 1997}; {Etz, H. et al., 2001}. One of the advantages of using recombinant expression libraries is that the identified hyperimmune serum-reactive antigens may be instantly produced by expression of the coding sequences of the screened and selected clones expressing the hyperimmune serum-reactive antigens without further recombinant DNA technology or cloning steps necessary.

The comprehensive set of antigens identified by the described program according to the present invention is analysed further by one or more additional rounds of screening. Therefore individual antibody preparations or antibodies generated against selected peptides which were identified as immunogenic are used. According to a preferred embodiment the individual antibody preparations for the second round of screening are derived from patients who have suffered from an acute infection with enterococci, especially from patients who show an antibody titer above a certain minimum level, for example an antibody titer being higher than 80 percentile, preferably higher than 90 percentile, especially higher than 95 percentile of the human (patient or healthy individual) sera tested. Using such high titer individual antibody preparations in the second screening round allows a very selective identification of the hyperimmune serum-reactive antigens and fragments thereof from *E. faecalis*.

Following the comprehensive screening procedure, the selected antigenic proteins, expressed as recombinant proteins or in vitro translated products, in case it can not be expressed in prokaryotic expression systems, or the identified antigenic peptides (produced synthetically) are tested in a second screening by a series of ELISA and Western blotting assays for the assessment of their immunogenicity with a large human serum collection (>100 uninfected, >50 patients sera).

It is important that the individual antibody preparations (which may also be the selected serum) allow a selective identification of the most promising candidates of all the hyperimmune serum-reactive antigens from all the promising candidates from the first round. Therefore, preferably at least 10 individual antibody preparations (i.e. antibody preparations (e.g. sera) from at least 10 different individuals having suffered from an infection to the chosen pathogen) should be used in identifying these antigens in the second screening round. Of course, it is possible to use also less than 10 individual preparations, however, selectivity of the step may not be optimal with a low number of individual antibody preparations. On the other hand, if a given hyperimmune serum-reactive antigen (or an antigenic fragment thereof) is recognized by at least 10 individual antibody preparations, preferably at least 30, especially at least 50 individual antibody preparations, identification of the hyperimmune serum-reactive antigen is also selective enough for a proper identification. Hyperimmune serum-reactivity may of course be tested with as many individual preparations as possible (e.g. with more than 100 or even with more than 1,000).

Therefore, the relevant portion of the hyperimmune serum-reactive antibody preparations according to the method of the present invention should preferably be at least 10, more preferred at least 30, especially at least 50 individual antibody preparations. Alternatively (or in combination) hyperimmune serum-reactive antigens may preferably be also identified with at least 20%, preferably at least 30%, especially at least 40% of all individual antibody preparations used in the second screening round.

According to a preferred embodiment of the present invention, the sera from which the individual antibody preparations for the second round of screening are prepared (or which are used as antibody preparations), are selected by their titer against *E. faecalis* (e.g. against a preparation of this pathogen, such as a lysate, cell wall components and recombinant proteins). Preferably, some are selected with a total IgG titer above 10,000 U, especially above 12,000 U (U=units, calculated from the $OD_{405nm}$ reading at a given dilution) when the whole organism (total lysate or whole cells) is used as antigen in the ELISA.

The antibodies produced against enterococci by the human immune system and present in human sera are indicative of the in vivo expression of the antigenic proteins and their immunogenicity. The recognition of linear epitopes by antibodies can be based on sequences as short as 4-5 amino acids. Of course it does not necessarily mean that these short peptides are capable of inducing the given antibody in vivo. For that reason the defined epitopes, polypeptides and proteins are further to be tested in animals (mainly in mice) for their capacity to induce antibodies against the selected proteins in vivo.

The preferred antigens are located on the cell surface or are secreted, and are therefore accessible extracellularly. Antibodies against cell wall proteins are expected to serve two purposes: to inhibit adhesion and to promote phagocytosis. Antibodies against secreted proteins are beneficial in neutralisation of their function as toxin or virulence component. It is also known that bacteria communicate with each other through secreted proteins. Neutralizing antibodies against these proteins will interrupt growth-promoting cross-talk between or within enterococcal species. Bioinformatic analyses (signal sequences, cell wall localisation signals, transmembrane domains) proved to be very useful in assessing cell surface localisation or secretion. The experimental approach includes the isolation of antibodies with the corresponding epitopes from human serum, and the generation of immune sera in mice against (poly)peptides selected by the bacterial surface display screens.

For that purpose, bacterial *E. coli* clones are directly injected into mice and immune sera are taken and tested in the relevant in vitro assay for functional opsonic or neutralizing antibodies. Alternatively, specific antibodies may be purified from human or mouse sera using peptides or proteins as substrate.

Host defence against *E. faecalis* relies mainly on innate immunological mechanisms. Inducing high affinity antibodies of the opsonic and neutralizing type by vaccination helps the innate immune system to eliminate bacteria and toxins. This makes the method according to the present invention an optimal tool for the identification of enterococcal antigenic proteins.

The skin and mucous membranes are formidable barriers against invasion by enterococci. However, once the skin or the mucous membranes are breached the first line of non-adaptive cellular defence begins its co-ordinate action through complement and phagocytes, especially the polymorphonuclear leukocytes (PMNs). These cells can be regarded as the cornerstones in eliminating invading bacteria. As enterococci are primarily extracellular pathogens, the major anti-enterococcal adaptive response comes from the humoral arm of the immune system, and is mediated through three major mechanisms: promotion of opsonization, toxin neutralisation, and inhibition of adherence. It is believed that opsonization is especially important, because of its requirement for an effective phagocytosis. For efficient opsonization the microbial surface has to be coated with antibodies and complement factors for recognition by PMNs through receptors to the Fc fragment of the IgG molecule or to activated C3b. After opsonization, enterococci are phagocytosed and killed. Antibodies bound to specific antigens on the cell surface of bacteria serve as ligands for the attachment to PMNs and to promote phagocytosis. The very same antibodies bound to the adhesins and other cell surface proteins are expected to neutralize adhesion and prevent colonization. The selection of antigens as provided by the present invention is thus well suited to identify those that will lead to protection against infection in an animal model or in humans.

According to the antigen identification method used herein, the present invention can surprisingly provide a set of comprehensive novel nucleic acids and novel hyperimmune serum reactive antigens and fragments thereof of *E. faecalis*, among other things, as described below. According to one aspect, the invention particularly relates to the nucleotide sequences encoding hyperimmune serum reactive antigens which sequences are set forth in the Sequence listing Seq ID No 1-170, 373-424 and the corresponding encoded amino acid sequences representing hyperimmune serum reactive antigens are set forth in the Sequence Listing Seq ID No 171-340 and 425-476.

In a preferred embodiment of the present invention, a nucleic acid molecule is provided which exhibits 70% identity over their entire length to a nucleotide sequence set forth with Seq ID No 1-2, 4-8, 10, 12-18, 20-23, 25-26, 29-43, 45-62, 64-74, 76-77, 79-83, 85-89, 91-92, 94-114, 117-126, 128-146, 148-170, 373, 375, 379-381, 387, 392, 394, 397-399, 407-408, 410-411 and 415-424. Most highly preferred are nucleic acids that comprise a region that is at least 80% or at least 85% identical over their entire length to a nucleic acid molecule set forth with Seq ID No 1-2, 4-8, 10, 12-18, 20-23, 25-26, 29-43, 45-62, 64-74, 76-77, 79-83, 85-89, 91-92, 94-114, 117-126, 128-146, 148-170, 373, 375, 379-381, 387, 392, 394, 397-399, 407-408, 410-411 and 415-424. In this regard, nucleic acid molecules at least 90%, 91%, 92%, 93%, 94%, 95%, or 96% identical over their entire length to the same are particularly preferred. Furthermore, those with at least 97% are highly preferred, those with at least 98% and at least 99% are particularly highly preferred, with at least 99% or 99.5% being the more preferred, with 100% identity being especially preferred. Moreover, preferred embodiments in this respect are nucleic acids which encode hyperimmune serum reactive antigens or fragments thereof (polypeptides) which retain substantially the same biological function or activity as the mature polypeptide encoded by said nucleic acids set forth in the Seq ID No 1-2, 4-8, 10, 12-18, 20-23, 25-26, 29-43, 45-62, 64-74, 76-77, 79-83, 85-89, 91-92, 94-114, 117-126, 128-146, 148-170, 373, 375, 379-381, 387, 392, 394, 397-399, 407-408, 410-411 and 415-424.

Identity, as known in the art and used herein, is the relationship between two or more polypeptide sequences or two or more polynucleotide sequences, as determined by comparing the sequences. In the art, identity also means the degree of sequence relatedness between polypeptide or polynucleotide sequences, as the case may be, as determined by the match between strings of such sequences. Identity can be readily calculated. While there exist a number of methods to measure identity between two polynucleotide or two polypeptide sequences, the term is well known to skilled artisans (e.g. *Sequence Analysis in Molecular Biology*, von Heinje, G., Academic Press, 1987). Preferred methods to determine identity are designed to give the largest match between the sequences tested. Methods to determine identity are codified in computer programs. Preferred computer program methods to determine identity between two sequences include, but are not limited to, GCG program package {Devereux, J. et al., 1984}, BLASTP, BLASTN, and FASTA {Altschul, S. et al., 1990}.

According to another aspect of the invention, nucleic acid molecules are provided which exhibit at least 96%, preferably at least 98%, especially 100% identity to the nucleic acid sequence set forth with Seq ID No 3, 9, 11, 24, 27, 44, 63, 75, 84, 115-116, 127, 374, 376-378, 382-386, 388-391, 393, 395-396, 400-406, 409 and 412-414.

According to a further aspect of the present invention, nucleic acid molecules are provided which are identical to the nucleic acid sequences set forth with Seq ID No 90, 147.

The nucleic acid molecules according to the present invention can as a second alternative also be a nucleic acid molecule which is at least essentially complementary to the nucleic acid described as the first alternative above. As used herein complementary means that a nucleic acid strand is base pairing via Watson-Crick base pairing with a second nucleic acid strand. Essentially complementary as used herein means that the base pairing is not occurring for all of the bases of the respective strands but leaves a certain number or percentage of the bases unpaired or wrongly paired. The percentage of correctly pairing bases is preferably at least 70%, more preferably at least 80%, even more preferably 90% and most preferably any percentage higher than 90%. It is to be noted that a percentage of 70% matching bases is considered as homology and the hybridization having this extent of matching base pairs is considered as stringent. Hybridization conditions for this kind of stringent hybridization may be taken from Current Protocols in Molecular Biology (John Wiley and Sons, Inc., 1987). More particularly, the hybridization conditions can be as follows:

Hybridization performed e.g. in 5×SSPE, 5×Denhardt's reagent, 0.1% SDS, 100 g/mL sheared DNA at 68° C.
Moderate stringency wash in 0.2×SSC, 0.1% SDS at 42° C.
High stringency wash in 0.1×SSC, 0.1% SDS at 68° C.
Genomic DNA with a GC content of 50% has an approximate $T_M$ of 96° C. For 1% mismatch, the $T_M$ is reduced by approximately 1° C.

In addition, any of the further hybridization conditions described herein are in principle applicable as well.

Of course, all nucleic acid sequence molecules which encode the same polypeptide molecule as those identified by the present invention are encompassed by any disclosure of a given coding sequence, since the degeneracy of the genetic code is directly applicable to unambiguously determine all possible nucleic acid molecules which encode a given polypeptide molecule, even if the number of such degenerated nucleic acid molecules may be high. This is also applicable for fragments of a given polypeptide, as long as the fragments encode a polypeptide being suitable to be used in a vaccination connection, e.g. as an active or passive vaccine.

The nucleic acid molecule according to the present invention can as a third alternative also be a nucleic acid which comprises a stretch of at least 15 bases of the nucleic acid molecule according to the first and second alternative of the nucleic acid molecules according to the present invention as outlined above. Preferably, the bases form a contiguous stretch of bases. However, it is also within the scope of the present invention that the stretch consists of two or more moieties which are separated by a number of bases.

The present nucleic acids may preferably consist of at least 20, even more preferred at least 30, especially at least 50 contiguous bases from the sequences disclosed herein. The suitable length may easily be optimized due to the planned area of use (e.g. as (PCR) primers, probes, capture molecules (e.g. on a (DNA) chip), etc.). Preferred nucleic acid molecules contain at least a contiguous 15 base portion of one or more of the predicted immunogenic amino acid sequences listed in tables 1 and 2, especially the sequences of table 2 with scores of more than 10, preferably more than 20, especially with a score of more than 25. Specifically preferred are nucleic acids containing a contiguous portion of a DNA sequence of any sequence in the sequence protocol of the present application which shows 1 or more, preferably more than 2, especially more than 5, non-identical nucleic acid residues compared to the published *Enterococcus faecalis* strain V583 genome {Paulsen, I. et al., 2003}; GenBank accession AE016830 (chromosome), AE016833 (pTEF1), AE016831 (pTEF2), AE016832 (pTEF3), and/or any other published *E. faecalis* genome sequence or parts thereof. Specifically preferred non-identical nucleic acid residues are residues which lead to a non-identical amino acid residue. Preferably, the nucleic acid sequences encode for polypeptides having at least 1, preferably at least 2, preferably at least three different amino acid residues compared to the published *S. pyogenes* counterparts mentioned above. Also such isolated polypeptides, being fragments of the proteins (or the whole protein) mentioned herein e.g. in the sequence listing, having at least 6, 7, or 8 amino acid residues and being encoded by these nucleic acids are preferred.

The nucleic acid molecule according to the present invention can as a fourth alternative also be a nucleic acid molecule which anneals under stringent hybridisation conditions to any of the nucleic acids of the present invention according to the above outlined first, second, and third alternative. Stringent hybridisation conditions are typically those described herein.

Finally, the nucleic acid molecule according to the present invention can as a fifth alternative also be a nucleic acid molecule which, but for the degeneracy of the genetic code, would hybridise to any of the nucleic acid molecules according to any nucleic acid molecule of the present invention according to the first, second, third, and fourth alternative as outlined above. This kind of nucleic acid molecule refers to the fact that preferably the nucleic acids according to the present invention code for the hyperimmune serum reactive antigens or fragments thereof according to the present invention. This kind of nucleic acid molecule is particularly useful in the detection of a nucleic acid molecule according to the present invention and thus the diagnosis of the respective microorganisms such as E. faecalis and any disease or diseased condition where this kind of microorganisms is involved. Preferably, the hybridisation would occur or be preformed under stringent conditions as described in connection with the fourth alternative described above.

Nucleic acid molecule as used herein generally refers to any ribonucleic acid molecule or deoxyribonucleic acid molecule, which may be unmodified RNA or DNA or modified RNA or DNA. Thus, for instance, nucleic acid molecule as used herein refers to, among other, single- and double-stranded DNA, DNA that is a mixture of single- and double-stranded RNA, and RNA that is a mixture of single- and double-stranded regions, hybrid molecules comprising DNA and RNA that may be single-stranded or, more typically, double-stranded, or triple-stranded, or a mixture of single- and double-stranded regions. In addition, nucleic acid molecule as used herein refers to triple-stranded regions comprising RNA or DNA or both RNA and DNA. The strands in such regions may be from the same molecule or from different molecules. The regions may include all of one or more of the molecules, but more typically involve only a region of some of the molecules. One of the molecules of a triple-helical region often is an oligonucleotide. As used herein, the term nucleic acid molecule includes DNAs or RNAs as described above that contain one or more modified bases. Thus, DNAs or RNAs with backbones modified for stability or for other reasons are "nucleic acid molecule" as that term is intended herein. Moreover, DNAs or RNAs comprising unusual bases, such as inosine, or modified bases, such as tritylated bases, to name just two examples, are nucleic acid molecule as the term is used herein. It will be appreciated that a great variety of modifications have been made to DNA and RNA that serve many useful purposes known to those of skill in the art. The term nucleic acid molecule as it is employed herein embraces such chemically, enzymatically or metabolically modified forms of nucleic acid molecule, as well as the chemical forms of DNA and RNA characteristic of viruses and cells, including simple and complex cells, inter alia. The term nucleic acid molecule also embraces short nucleic acid molecules often referred to as oligonucleotide(s). "Polynucleotide" and "nucleic acid" or "nucleic acid molecule" are often used interchangeably herein.

Nucleic acid molecules provided in the present invention also encompass numerous unique fragments, both longer and shorter than the nucleic acid molecule sequences set forth in the sequencing listing of the E. faecalis coding regions, which can be generated by standard cloning methods. To be unique, a fragment must be of sufficient size to distinguish it from other known nucleic acid sequences, most readily determined by comparing any selected E. faecalis fragment to the nucleotide sequences in computer databases such as GenBank.

Additionally, modifications can be made to the nucleic acid molecules and polypeptides that are encompassed by the present invention. For example, nucleotide substitutions can be made which do not affect the polypeptide encoded by the nucleic acid, and thus any nucleic acid molecule which encodes a hyperimmune serum reactive antigen or fragments thereof is encompassed by the present invention.

Furthermore, any of the nucleic acid molecules encoding hyperimmune serum reactive antigens or fragments thereof provided by the present invention can be functionally linked, using standard techniques such as standard cloning techniques, to any desired regulatory sequences, whether a E. faecalis regulatory sequence or a heterologous regulatory sequence, heterologous leader sequence, heterologous marker sequence or a heterologous coding sequence to create a fusion protein.

Nucleic acid molecules of the present invention may be in the form of RNA, such as mRNA or cRNA, or in the form of DNA, including, for instance, cDNA and genomic DNA obtained by cloning or produced by chemical synthetic techniques or by a combination thereof. The DNA may be triple-stranded, double-stranded or single-stranded. Single-stranded DNA may be the coding strand, also known as the sense strand, or it may be the non-coding strand, also referred to as the anti-sense strand.

The present invention further relates to variants of the herein above described nucleic acid molecules which encode fragments, analogs and derivatives of the hyperimmune serum reactive antigens and fragments thereof having a deducted E. faecalis amino acid sequence set forth in the Sequence Listing. A variant of the nucleic acid molecule may be a naturally occurring variant such as a naturally occurring allelic variant, or it may be a variant that is not known to occur naturally. Such non-naturally occurring variants of the nucleic acid molecule may be made by mutagenesis techniques, including those applied to nucleic acid molecules, cells or organisms.

Among variants in this regard are variants that differ from the aforementioned nucleic acid molecules by nucleotide substitutions, deletions or additions. The substitutions, deletions or additions may involve one or more nucleotides. The variants may be altered in coding or non-coding regions or both. Alterations in the coding regions may produce conservative or non-conservative amino acid substitutions, deletions or additions. Preferred are nucleic acid molecules encoding a variant, analog, derivative or fragment, or a variant, analogue or derivative of a fragment, which have a E. faecalis sequence as set forth in the Sequence Listing, in which several, a few, 5 to 10, 1 to 5, 1 to 3, 2, 1 or no amino acid(s) is substituted, deleted or added, in any combination. Especially preferred among these are silent substitutions, additions and deletions, which do not alter the properties and activities of the E. faecalis polypeptides set forth in the Sequence Listing. Also especially preferred in this regard are conservative substitutions.

The peptides and fragments according to the present invention also include modified epitopes wherein preferably one or two of the amino acids of a given epitope are modified or replaced according to the rules disclosed in e.g. {Tourdot, S. et al., 2000}, as well as the nucleic acid sequences encoding such modified epitopes.

It is clear that also epitopes derived from the present epitopes by amino acid exchanges improving, conserving or at least not significantly impeding the T cell activating capability of the epitopes are covered by the epitopes according to the present invention. Therefore the present epitopes also cover epitopes, which do not contain the original sequence as derived from *E. faecalis*, but trigger the same or preferably an improved T cell response. These epitope are referred to as "heteroclitic"; they need to have a similar or preferably greater affinity to MHC/HLA molecules, and the need the ability to stimulate the T cell receptors (TCR) directed to the original epitope in a similar or preferably stronger manner.

Heteroclitic epitopes can be obtained by rational design i.e. taking into account the contribution of individual residues to binding to MHC/HLA as for instance described by {Rammensee, H. et al., 1999}, combined with a systematic exchange of residues potentially interacting with the TCR and testing the resulting sequences with T cells directed against the original epitope. Such a design is possible for a skilled man in the art without much experimentation.

Another possibility includes the screening of peptide libraries with T cells directed against the original epitope. A preferred way is the positional scanning of synthetic peptide libraries. Such approaches have been described in detail for instance by {Hemmer, B. et al., 1999} and the references given therein.

As an alternative to epitopes represented by the present derived amino acid sequences or heteroclitic epitopes, also substances mimicking these epitopes e.g. "peptidemimetica" or "retro-inverso-peptides" can be applied.

Another aspect of the design of improved epitopes is their formulation or modification with substances increasing their capacity to stimulate T cells. These include T helper cell epitopes, lipids or liposomes or preferred modifications as described in WO 01/78767.

Another way to increase the T cell stimulating capacity of epitopes is their formulation with immune stimulating substances for instance cytokines or chemokines like interleukin-2, -7, -12, -18, class I and II interferons (IFN), especially IFN-gamma, GM-CSF, TNF-alpha, flt3-ligand and others.

As discussed additionally herein regarding nucleic acid molecule assays of the invention, for instance, nucleic acid molecules of the invention as discussed above, may be used as a hybridization probe for RNA, cDNA and genomic DNA to isolate full-length cDNAs and genomic clones encoding polypeptides of the present invention and to isolate cDNA and genomic clones of other genes that have a high sequence similarity to the nucleic acid molecules of the present invention. Such probes generally will comprise at least 15 bases. Preferably, such probes will have at least 20, at least 25 or at least 30 bases, and may have at least 50 bases. Particularly preferred probes will have at least 30 bases, and will have 50 bases or less, such as 30, 35, 40, 45, or 50 bases.

For example, the coding region of a nucleic acid molecule of the present invention may be isolated by screening a relevant library using the known DNA sequence to synthesize an oligonucleotide probe. A labeled oligonucleotide having a sequence complementary to that of a gene of the present invention is then used to screen a library of cDNA, genomic DNA or mRNA to determine to which members of the library the probe hybridizes.

The nucleic acid molecules and polypeptides of the present invention may be employed as reagents and materials for development of treatments of and diagnostics for disease, particularly human disease, as further discussed herein relating to nucleic acid molecule assays, inter alia.

The nucleic acid molecules of the present invention that are oligonucleotides can be used in the processes herein as described, but preferably for PCR, to determine whether or not the *E. faecalis* genes identified herein in whole or in part are present and/or transcribed in infected tissue such as blood.

It is recognized that such sequences will also have utility in diagnosis of the stage of infection and type of infection the pathogen has attained. For this and other purposes the arrays comprising at least one of the nucleic acids according to the present invention as described herein, may be used.

The nucleic acid molecules according to the present invention may be used for the detection of nucleic acid molecules and organisms or samples containing these nucleic acids. Preferably such detection is for diagnosis, more preferable for the diagnosis of a disease related or linked to the present or abundance of *E. faecalis*.

Eukaryotes (herein also "individual(s)"), particularly mammals, and especially humans, infected with *E. faecalis* may be identifiable by detecting any of the nucleic acid molecules according to the present invention detected at the DNA level by a variety of techniques. Preferred nucleic acid molecules candidates for distinguishing a *E. faecalis* from other organisms can be obtained.

The invention provides a process for diagnosing disease, arising from infection with *E. faecalis*, comprising determining from a sample isolated or derived from an individual an increased level of expression of a nucleic acid molecule having the sequence of a nucleic acid molecule set forth in the Sequence Listing. Expression of nucleic acid molecules can be measured using any one of the methods well known in the art for the quantitation of nucleic acid molecules, such as, for example, PCR, RT-PCR, Rnase protection, Northern blotting, other hybridisation methods and the arrays described herein.

Isolated as used herein means separated "by the hand of man" from its natural state; i.e., that, if it occurs in nature, it has been changed or removed from its original environment, or both. For example, a naturally occurring nucleic acid molecule or a polypeptide naturally present in a living organism in its natural state is not "isolated," but the same nucleic acid molecule or polypeptide separated from the coexisting materials of its natural state is "isolated", as the term is employed herein. As part of or following isolation, such nucleic acid molecules can be joined to other nucleic acid molecules, such as DNAs, for mutagenesis, to form fusion proteins, and for propagation or expression in a host, for instance. The isolated nucleic acid molecules, alone or joined to other nucleic acid molecules such as vectors, can be introduced into host cells, in culture or in whole organisms. Introduced into host cells in culture or in whole organisms, such DNAs still would be isolated, as the term is used herein, because they would not be in their naturally occurring form or environment. Similarly, the nucleic acid molecules and polypeptides may occur in a composition, such as a media formulations, solutions for introduction of nucleic acid molecules or polypeptides, for example, into cells, compositions or solutions for chemical or enzymatic reactions, for instance, which are not naturally occurring compositions, and, therein remain isolated nucleic acid molecules or polypeptides within the meaning of that term as it is employed herein.

The nucleic acids according to the present invention may be chemically synthesized. Alternatively, the nucleic acids can be isolated from *E. faecalis* by methods known to the one skilled in the art.

According to another aspect of the present invention, a comprehensive set of novel hyperimmune serum reactive antigens and fragments thereof are provided by using the herein described antigen identification method. In a preferred embodiment of the invention, a hyperimmune serum-reactive antigen comprising an amino acid sequence being encoded by any one of the nucleic acids molecules herein described and fragments thereof are provided. In another preferred embodiment of the invention a novel set of hyperimmune serum-reactive antigens which comprises amino acid sequences selected from a group consisting of the polypeptide sequences as represented in Seq ID No 171-172, 174-178, 180, 182-188, 190-193, 195-196, 199-213, 215-232, 234-244, 246-247, 249-253, 255-259, 261-262, 264-284, 287-296, 298-316, 318-340, 425, 427, 431-433, 439, 444, 446, 449-451, 459-460, 462-463 and 467-476 and fragments thereof are provided. In a further preferred embodiment of the invention hyperimmune serum-reactive antigens which comprise amino acid sequences selected from a group consisting of the polypeptide sequences as represented in Seq ID No 173, 179, 181, 194, 197, 214, 233, 245, 254, 285-286, 297, 426, 428-430, 434-438, 440-443, 445, 447-448, 452-458, 461 and 464-466 and fragments thereof are provided. In a still preferred embodiment of the invention hyperimmune serum-reactive antigens which comprise amino acid sequences selected from a group consisting of the polypeptide sequences as represented in Seq ID No 260, 317 and fragments thereof are provided.

The hyperimmune serum reactive antigens and fragments thereof as provided in the invention include any polypeptide set forth in the Sequence Listing as well as polypeptides which have at least 70% identity to a polypeptide set forth in the Sequence Listing, preferably at least 80% or 85% identity to a polypeptide set forth in the Sequence Listing, and more preferably at least 90% similarity (more preferably at least 90% identity) to a polypeptide set forth in the Sequence Listing and still more preferably at least 95%, 96%, 97%, 98%, 99% or 99.5% similarity (still more preferably at least 95%, 96%, 97%, 98%, 99%, or 99.5% identity) to a polypeptide set forth in the Sequence Listing and also include portions of such polypeptides with such portion of the polypeptide generally containing at least 4 amino acids and more preferably at least 8, still more preferably at least 30, still more preferably at least 50 amino acids, such as 4, 8, 10, 20, 30, 35, 40, 45 or 50 amino acids.

The invention also relates to fragments, analogs, and derivatives of these hyperimmune serum reactive antigens and fragments thereof. The terms "fragment", "derivative" and "analog" when referring to an antigen whose amino acid sequence is set forth in the Sequence Listing, means a polypeptide which retains essentially the same or a similar biological function or activity as such hyperimmune serum reactive antigen and fragment thereof.

The fragment, derivative or analog of a hyperimmune serum reactive antigen and fragment thereof may be 1) one in which one or more of the amino acid residues are substituted with a conserved or non-conserved amino acid residue (preferably a conserved amino acid residue) and such substituted amino acid residue may or may not be one encoded by the genetic code, or 2) one in which one or more of the amino acid residues includes a substituent group, or 3) one in which the mature hyperimmune serum reactive antigen or fragment thereof is fused with another compound, such as a compound to increase the half-life of the hyperimmune serum reactive antigen and fragment thereof (for example, polyethylene glycol), or 4) one in which the additional amino acids are fused to the mature hyperimmune serum reactive antigen or fragment thereof, such as a leader or secretory sequence or a sequence which is employed for purification of the mature hyperimmune serum reactive antigen or fragment thereof or a proprotein sequence. Such fragments, derivatives and analogs are deemed to be within the scope of those skilled in the art from the teachings herein.

The present invention also relates to antigens of different *E. faecalis* isolates. Such homologues may easily be isolated based on the nucleic acid and amino acid sequences disclosed herein. The presence of any antigen can accordingly be determined for every M serotype. In addition it is possible to determine the variability of a particular antigen in the various serotypes as described for the sic gene {Hoe, N. et al., 2001}. The contribution of the various serotypes to the different enterococcal infections varies in the different age groups and geographical regions. It is an important aspect that the most valuable protective antigens are expected to be conserved among various clinical strains.

Among the particularly preferred embodiments of the invention in this regard are the hyperimmune serum reactive antigens set forth in the Sequence Listing, variants, analogs, derivatives and fragments thereof, and variants, analogs and derivatives of fragments. Additionally, fusion polypeptides comprising such hyperimmune serum reactive antigens, variants, analogs, derivatives and fragments thereof, and variants, analogs and derivatives of the fragments are also encompassed by the present invention. Such fusion polypeptides and proteins, as well as nucleic acid molecules encoding them, can readily be made using standard techniques, including standard recombinant techniques for producing and expression of a recombinant polynucleic acid encoding a fusion protein.

Among preferred variants are those that vary from a reference by conservative amino acid substitutions. Such substitutions are those that substitute a given amino acid in a polypeptide by another amino acid of like characteristics. Typically seen as conservative substitutions are the replacements, one for another, among the aliphatic amino acids Ala, Val, Leu and Ile; interchange of the hydroxyl residues Ser and Thr, exchange of the acidic residues Asp and Glu, substitution between the amide residues Asn and Gln, exchange of the basic residues Lys and Arg and replacements among the aromatic residues Phe and Tyr.

Further particularly preferred in this regard are variants, analogs, derivatives and fragments, and variants, analogs and derivatives of the fragments, having the amino acid sequence of any polypeptide set forth in the Sequence Listing, in which several, a few, 5 to 10, 1 to 5, 1 to 3, 2, 1 or no amino acid residues are substituted, deleted or added, in any combination. Especially preferred among these are silent substitutions, additions and deletions, which do not alter the properties and activities of the polypeptide of the present invention. Also especially preferred in this regard are conservative substitutions. Most highly preferred are polypeptides having an amino acid sequence set forth in the Sequence Listing without substitutions.

The hyperimmune serum reactive antigens and fragments thereof of the present invention are preferably provided in an isolated form, and preferably are purified to homogeneity.

Also among preferred embodiments of the present invention are polypeptides comprising fragments of the polypeptides having the amino acid sequence set forth in the Sequence Listing, and fragments of variants and derivatives of the polypeptides set forth in the Sequence Listing.

In this regard a fragment is a polypeptide having an amino acid sequence that entirely is the same as part but not all of the amino acid sequence of the afore mentioned hyperimmune serum reactive antigen and fragment thereof, and variants or derivative, analogs, fragments thereof. Such fragments may be "free-standing", i.e., not part of or fused to other amino acids or polypeptides, or they may be comprised within a larger polypeptide of which they form a part or region. Also preferred in this aspect of the invention are fragments characterised by structural or functional attributes of the polypeptide of the present invention, i.e. fragments that comprise alpha-helix and alpha-helix forming regions, beta-sheet and beta-sheet forming regions, turn and turn-forming regions, coil and coil-forming regions, hydrophilic regions, hydrophobic regions, alpha amphipathic regions, beta-amphipathic regions, flexible regions, surface-forming regions, substrate binding regions, and high antigenic index regions of the polypeptide of the present invention, and combinations of such fragments. Preferred regions are those that mediate activities of the hyperimmune serum reactive antigens and fragments thereof of the present invention. Most highly preferred in this regard are fragments that have a chemical, biological or other activity of the hyperimmune serum reactive antigen and fragments thereof of the present invention, including those with a similar activity or an improved activity, or with a decreased undesirable activity. Particularly preferred are fragments comprising receptors or domains of enzymes that confer a function essential for viability of *E. faecalis* or the ability to cause disease in humans. Further preferred polypeptide fragments are those that comprise or contain antigenic or immunogenic determinants in an animal, especially in a human.

An antigenic fragment is defined as a fragment of the identified antigen which is for itself antigenic or may be made antigenic when provided as a hapten. Therefore, also antigens or antigenic fragments showing one or (for longer fragments) only a few amino acid exchanges are enabled with the present invention, provided that the antigenic capacities of such fragments with amino acid exchanges are not severely deteriorated on the exchange(s), i.e., suited for eliciting an appropriate immune response in an individual vaccinated with this antigen and identified by individual antibody preparations from individual sera.

Preferred examples of such fragments of a hyperimmune serum-reactive antigen are selected from the group consisting of peptides comprising amino acid sequences of column "predicted immunogenic aa", and "Location of identified immunogenic region" of Table 1a and Table 1c; the serum reactive epitopes of Table 2, especially peptides comprising amino acid 4-10, 14-21, 30-36, 59-68, 77-82, 87-93, 96-105, 112-121, 125-133, 135-141, 150-162, 164-183, 192-203, 207-213, 215-226, 228-234, 241-247, 250-285, 302-308 and 135-148 of Seq ID No 171; 15-57, 60-73, 77-101, 108-134, 136-177, 185-201, 203-217, 226-240, 244-254, 272-277, 283-288, 292-343, 354-370, 380-398, 406-437, 439-453, 473-490, 532-538, 584-590, 595-601, 606-612, 664-677, 679-704, 715-724, 731-753, 759-772, 786-794, 814-862 and 657-684 of Seq ID No 172; 4-9, 15-36, 41-47, 54-60, 75-81, 114-120, 131-146, 152-158, 174-182, 194-202, 208-215, 218-226, 255-271, 276-285, 290-295, 302-311, 318-328, 330-344, 352-359, 365-377, 388-395, 398-405, 426-432, 439-449, 455-500, 505-513, 531-537, 542-552, 554-561, 587-595, 606-612, 718-734, 763-771, 775-782, 792-801, 805-812, 822-828, 830-843, 849-863, 876-894, 905-911, 919-926, 935-947, 949-958, 968-979, 1009-1016, 1029-1045, 1047-1056, 1076-1081, 1092-1106, 1123-1133, 1179-1200, 1202-1211, 1215-1223, 1287-1299, 1301-1306, 398-431 and 1224-1237 of Seq ID No 173; 17-47, 74-80, 90-97, 126-133, 137-148, 167-173, 179-185, 214-223, 250-255, 270-283, 329-338, 342-350, 352-358, 360-367, 372-383, 398-404, 411-421, 426-432, 435-446, 452-462, 472-479, 515-521, 582-592, 611-618, 623-629, 642-659, 666-673, 678-689, 704-725, 732-737, 744-757, 768-789, 824-834, 842-849, 862-868, 877-887, 904-916, 923-928, 941-947, 962-974, 982-992, 1019-1030, 1032-1044, 1046-1052, 1065-1075, 1077-1087, 1108-1121, 1124-1132, 1137-1151, 1170-1182, 1190-1206, 1208-1214, 1227-1233, 1242-1251, 1254-1273, 1282-1298 and 792-825 of Seq ID No 174; 19-31, 39-67, 82-91, 104-110, 113-128, 149-155, 161-181 and 137-155 of Seq ID No 175; 6-18, 54-63, 69-85, 110-127, 142-156, 158-167, 169-211, 238-246, 248-257, 276-311, 339-349, 371-380, 385-391, 394-403, 421-438, 451-456, 483-489 and 449-468 of Seq ID No 176; 5-15, 24-34, 50-56, 61-83, 98-121, 123-136, 149-162, 166-194, 202-215, 221-227, 229-332, 337-360, 367-402, 404-415, 427-433, 444-462, 471-478, 487-498, 511-518, 521-544, 550-563, 568-574, 580-587, 597-607, 610-616, 624-629 and 468-498 of Seq ID No 177; 11-19, 32-49, 57-63, 65-71, 80-89, 91-133, 166-181, 183-191, 201-230, 234-257, 264-291, 297-303, 305-314, 316-335, 337-354, 359-366, 368-374, 383-388, 394-405, 408-442, 446-470, 483-490, 499-505, 513-538, 544-555, 557-563, 568-590, 598-608, 617-623, 627-636, 641-647, 667-685, 687-693, 710-723, 733-739, 742-754, 769-815 and 366-388 of Seq ID No 178; 4-16, 30-35, 42-53, 67-76, 82-87, 101-108, 112-130, 132-138, 147-152, 161-183, 187-208, 218-225, 265-281, 295-303, 305-317, 322-334, 338-357, 360-368, 370-383, 387-394, 400-419, 421-430 and 255-336 of Seq ID No 179; 19-27, 36-47, 59-66, 76-83, 101-112, 118-125, 142-147, 162-180, 185-196, 225-240, 246-263, 286-304, 314-319, 327-333, 353-367 and 194-214 of Seq ID No 180; 14-43, 70-76, 83-89, 111-117, 122-128, 136-145, 163-170, 175-182, 210-219, 246-251, 266-279, 325-331, 338-346, 348-354, 356-363, 368-379, 422-428, 431-441, 450-456, 466-473, 509-515, 532-542, 549-556, 576-586, 605-612, 617-623, 636-653, 660-667, 674-686, 698-719, 726-731, 738-745, 762-783, 818-828, 836-843, 856-862, 871-881, 903-910, 917-922, 935-941, 956-968, 976-986, 1013-1024, 1026-1038, 1059-1069, 1071-1081, 1102-1115, 1118-1126, 1131-1145, 1164-1176, 1187-1200, 1202-1208, 1221-1227, 1236-1245, 1248-1267, 1273-1292, 252-287 and 805-844 of Seq ID No 181; 4-18, 21-28, 37-43, 56-70, 101-113, 131-140, 142-150, 162-170, 172-184, 193-204, 209-227, 233-238, 246-264 and 93-168 of Seq ID No 182; 14-20, 44-50, 61-70, 77-96, 99-106, 129-142, 168-181, 187-196, 205-221, 225-241, 277-296 and 257-281 of Seq ID No 183; 18-29, 43-54, 64-76, 78-84, 88-103, 125-149, 159-176, 198-218, 230-242, 256-271, 279-285, 287-293, 300-306, 325-331, 344-351, 357-364, 371-397, 400-414, 419-464, 485-515, 517-526, 529-537, 548-553, 573-580, 584-590, 603-620, 639-661, 676-681, 687-700, 716-761, 772-780, 785-790, 795-803, 823-836, 848-853 and 106-134 of Seq ID No 184; 7-13, 19-42, 44-51, 55-75, 87-97, 99-110, 112-118, 129-135, 141-156, 158-178, 213-220, 230-286, 294-308, 323-338, 345-352, 355-365, 370-392, 394-419, 437-446, 454-460, 474-497, 515-526, 528-546, 569-575 and 128-141 of Seq ID No 185; 12-20, 24-33, 45-70, 73-84, 86-94, 103-116, 118-124, 135-142, 163-170, 176-200, 202-224, 226-234, 237-248, 250-262, 265-287, 296-307, 334-341, 347-356, 361-369, 382-396, 405-415, 418-427, 431-439, 443-449, 452-461, 467-474 and 113-146 of Seq ID No 186; 13-38, 44-50, 52-59, 66-72, 83-94, 103-110, 116-124, 131-137, 158-180, 199-204, 218-233, 241-264, 269-317, 326-342, 350-356 and 70-86 of Seq ID No 187; 29-35, 49-59, 63-84, 86-97, 103-111, 113-126, 130-144, 150-158, 174-198, 221-231, 250-264, 266-273, 291-298, 310-318 and 70-90 of Seq ID No 188; 19-25, 28-52, 60-66, 71-76, 131-142, 149-155, 157-178, 181-213, 218-223, 237-242, 250-257, 260-266, 272-279, 282-290, 321-330, 373-385, 393-407, 441-453, 461-475, 509-521, 529-542, 577-589, 597-610, 643-655, 663-677, 703-718, 729-734, 358-464, 495-570 and 604-685 of Seq ID No 189; 4-29, 51-76, 116-136, 158-173, 179-193, 207-215 and 86-111 of Seq ID No 190; 5-23, 45-70, 79-90, 93-107, 114-122, 142-151 and 18-36 of Seq ID No 191; 9-51, 68-120, 133-149, 158-180, 186-206, 211-220, 222-237, 248-293, 296-310, 317-339 and 248-260 of Seq ID No 192; 14-24, 44-63, 69-98, 108-119, 123-136, 155-161, 164-176, 180-193, 203-208, 215-223, 239-247, 274-281, 283-289, 296-304, 306-313, 315-327, 331-341, 343-353, 357-386, 392-405 and 205-246 of Seq ID No 193; 5-13, 16-23, 36-42, 53-63, 70-83, 96-102 and 14-34 of Seq ID No 194; 4-13, 19-35, 49-56, 59-76, 83-107, 121-134, 144-153, 157-164, 166-186, 194-202, 209-216, 231-253, 257-264 and 98-134 of Seq ID No 195; 16-32, 38-47, 58-68, 78-89, 98-114, 117-123, 132-141, 146-156, 164-170, 179-188, 196-212, 219-230, 232-237, 244-263, 265-274, 278-293, 297-303, 306-326, 339-349, 352-359, 362-367, 373-379, 384-394, 396-406, 423-443, 451-461, 465-484, 490-497, 504-511, 523-533, 537-547, 550-556, 558-566, 573-579, 586-593, 598-609, 615-642, 647-665, 671-686, 693-713, 723-728 and 332-378 of Seq ID No 196; 6-21, 34-44, 58-64, 66-74, 79-87, 114-127, 129-143, 154-162, 174-189, 205-214, 241-262, 266-273, 278-297, 319-324, 328-338, 342-351, 390-398, 409-415, 422-435, 458-464, 471-477, 481-486, 506-531, 534-540, 542-550 and 315-389 of Seq ID No 197; 4-28, 39-45, 52-58, 69-82, 93-115, 122-128, 135-140, 146-163, 177-192, 209-215, 221-232, 271-284, 331-337, 341-352, 360-378, 383-390, 392-401, 409-422, 428-435, 462-470, 474-480, 482-496, 531-539, 541-549, 551-560, 562-569, 576-582, 598-618 and 98-127 of Seq ID No 198; 14-27, 33-47, 61-79, 94-104, 119-133 and 36-60 of Seq ID No 199; 11-22, 29-40, 48-62, 68-73, 96-106, 108-118, 125-149 and 102-126 of Seq ID No 200; 4-11, 45-55, 76-83, 86-102, 105-112, 138-144, 147-153 and 20-48 of Seq ID No 201; 12-20, 28-56, 62-68, 72-82, 93-99, 101-107, 120-133, 135-145, 178-186, 208-232, 279-292 and 36-64 of Seq ID No 202; 6-14, 23-48, 65-82, 92-134, 140-181, 188-219, 228-238, 244-253, 255-261 and 124-145 of Seq ID No 203; 11-25, 31-38, 53-59, 62-71, 89-99, 125-133, 151-157, 182-190, 195-203, 208-215, 219-229, 249-262, 267-275, 287-295, 298-316, 318-325, 328-334, 344-353, 357-363, 371-377, 385-391, 396-415, 425-436, 438-457, 471-485, 538-552, 554-561, 606-625, 630-636, 646-653, 669-679, 695-704, 706-715, 722-747, 763-773 and 714-738 of Seq ID No 204; 10-29, 33-45, 50-60, 70-79, 83-95, 118-124, 136-157, 176-184, 192-205, 207-216, 223-234, 240-246, 258-268, 275-283 and 37-56 of Seq ID No 205; 4-24, 27-38, 46-54, 66-72, 81-97, 112-119, 128-137, 152-157, 173-179, 185-214, 219-225, 227-248, 262-284, 286-295, 301-307 and 117-134 of Seq ID No 206; 26-43, 49-56, 60-71, 74-82, 87-98, 110-116, 131-146, 154-164, 169-178, 183-189, 205-214, 241-246, 255-268, 275-292, 305-314, 316-323, 326-340, 346-363, 397-402, 419-429, 440-446, 452-461, 467-475 and 29-66 of Seq ID No 207; 7-16, 21-39, 48-58, 61-78, 82-89, 109-136, 138-150, 152-176, 182-247, 255-261, 267-332, 336-345, 347-358, 362-368, 371-392, 394-404, 407-472, 490-498, 505-513, 527-544, 554-582, 603-611, 614-620, 632-638 and 500-523 of Seq ID No 208; 24-46, 77-83, 90-97, 99-118, 123-166, 168-177, 204-212, 229-239, 248-262, 273-282, 287-293, 300-319, 321-337, 340-352, 357-366, 391-402, 411-428, 442-450, 464-471, 479-489 and 19-40 of Seq ID No 209; 9-23, 25-34, 53-58, 70-86, 90-97, 99-116, 118-128, 131-141, 185-191, 228-233, 237-253, 255-261, 264-271, 273-280, 302-312, 319-349, 351-359, 362-369, 376-383, 387-394, 398-406, 419-434 and 20-31 of Seq ID No 210; 15-22, 37-43, 71-87, 105-115, 121-127, 135-142, 152-158 and 32-52 of Seq ID No 211; 6-12, 18-29, 37-47, 50-58, 65-83, 85-91, 94-99, 108-123, 142-150, 156-163, 183-193, 215-222, 242-249, 252-258, 261-270, 285-308, 318-326 and 1-95 of Seq ID No 212; 9-61, 65-133, 144-155, 166-173, 175-221, 233-276, 278-313, 329-368 and 210-233 of Seq ID No 213; 11-29, 33-39, 46-51, 65-93, 107-113, 134-143, 147-154, 166-177, 181-188, 214-220, 233-243, 263-269 and 112-128 of Seq ID No 214; 8-46, 110-134, 155-167, 174-183, 188-201, 210-230, 253-258, 267-282, 289-299, 312-319, 322-327, 330-337, 365-381, 389-402, 405-411, 419-425, 439-447, 465-472, 489-512, 525-532, 540-554, 577-589, 591-599, 605-614, 616-624, 633-649 and 503-529 of Seq ID No 215; 34-49, 64-70, 90-118, 124-131, 141-152, 159-165 and 112-128 of Seq ID No 216; 5-15, 26-45, 55-72, 80-85, 93-100, 121-133, 142-148, 154-167, 198-205, 209-215, 241-254, 260-265, 271-279 and 244-270 of Seq ID No 217; 4-36, 38-54, 67-83, 122-153, 159-178, 205-212, 232-242, 244-253, 259-268, 281-288, 298-309, 324-331, 334-370, 372-381, 389-401, 403-429, 441-450, 456-462, 465-471, 473-479, 483-504, 508-518, 537-543, 553-565, 578-584, 592-609, 619-625, 658-667, 669-679, 712-719, 722-729, 737-744, 746-752, 758-765 and 180-226 of Seq ID No 218; 6-17, 23-32, 49-56, 61-67, 76-83, 85-103, 105-111, 120-132, 145-171, 175-185, 191-225, 231-246 and 99-128 of Seq ID No 219; 4-24, 28-48, 52-58, 64-79, 87-100, 104-120, 136-152, 159-166 and 150-163 of Seq ID No 220; 15-27, 65-71, 77-99, 104-121, 128-154, 183-216, 223-229, 234-255, 277-287, 296-308 and 77-97 of Seq ID No 221; 8-18, 44-76, 102-109 and 49-57 of Seq ID No 222; 5-14, 28-40, 42-51, 54-60, 77-83, 89-100, 117-124, 146-172, 176-204, 216-231, 237-244, 267-278, 324-334, 342-348, 396-401, 427-433, 438-450, 452-457, 465-471, 473-481, 491-500, 509-515, 523-544, 550-556, 558-569, 589-595, 606-618, 625-632, 640-649, 665-671, 678-688, 691-698, 717-723, 728-734, 781-789, 800-805, 812-821, 833-868, 873-879, 889-905, 929-939, 988-998, 1046-1061, 1073-1079, 1089-1096, 1115-1124, 1132-1140, 1172-1196, 1220-1226, 1231-1249, 1269-1277, 1287-1301, 1307-1330, 1350-1361, 1369-1378, 1387-1412, 1414-1420, 1422-1439, 1484-1491, 1513-1529, 1552-1561, 1576-1583, 1606-1613, 1617-1640, 1647-1654, 1665-1679, 1686-1698, 1709-1727, 1736-1743, 1750-1757, 1771-1790, 1801-1807, 1817-1823, 1831-1842, 1859-1868, 1870-1882, 1884-1891, 1900-1906, 1909-1914, 1929-1935, 1952-1960, 1974-1988, 2002-2011, 2032-2063, 2071-2081, 2116-2124, 2139-2147, 2149-2159, 2163-2190, 2209-2215, 2245-2253, 2282-2287, 2331-2342, 2360-2370, 2379-2393, 2402-2408, 2414-2421, 2423-2430, 2433-2439, 2442-2450, 2472-2478, 2485-2493, 2495-2503, 2506-2512, 2547-2554, 2558-2564, 2615-2625, 2637-2652, 2692-2698, 2700-2706, 2711-2723, 2731-2740, 2748-2753, 2756-2762, 2765-2772, 2781-2798, 2810-2824, 2844-2852, 2885-2899, 2912-2922, 2937-2944, 2947-2970, 2988-2998, 3016-3025, 3032-3037, 3062-3071, 3129-3148, 3156-3161 and 530-607 of Seq ID No 223; 31-36, 57-62, 79-85, 90-96, 99-112, 120-146, 162-185, 193-203, 208-217, 219-226, 239-253, 283-290, 298-304, 306-321, 340-349, 351-361, 365-372, 386-395, 407-438, 473-486, 537-551, 558-568, 576-594, 598-604 and 75-95 of Seq ID No 224; 14-19, 24-30, 34-42, 45-52, 54-64, 66-82, 95-105, 107-118, 126-163, 171-177, 184-201, 210-215, 260-269, 273-279, 288-304, 321-327, 358-364, 370-375, 380-387, 394-404, 407-413, 421-431, 436-451, 465-474, 504-511, 531-552, 578-587, 614-626, 629-636, 638-671, 691-715, 719-729, 733-745, 752-759, 768-777, 785-792, 794-802, 805-824, 844-854, 867-880, 885-891, 893-902, 907-924, 939-948, 955-964, 966-975, 987-1000, 1012-1017, 1023-1028, 1050-1071, 1083-1098, 1102-1115, 1133-1146, 1170-1183, 1204-1211, 1213-1223, 1262-1311, 1313-1319, 1346-1355, 1366-1371, 1383-1405, 1409-1414 and 776-819 of Seq ID No 225; 12-27, 30-38, 54-61, 64-74, 82-96, 103-110, 117-125, 134-140, 147-158, 185-201, 218-225, 232-253, 265-280, 319-325, 350-362, 366-372, 376-386, 464-483, 485-490, 511-521, 531-537, 542-559, 564-574, 593-609, 613-619, 637-642, 668-677 and 195-214 of Seq ID No 226; 4-21, 59-67, 73-79, 84-91, 141-151, 186-197, 203-214, 222-227, 237-245, 255-260, 281-292, 294-311, 336-344, 346-355, 422-437, 459-466, 484-491 and 77-109 of Seq ID No 227; 10-45, 52-61, 63-70, 74-102, 112-122, 124-132, 164-178, 181-205, 212-240, 246-256 and 226-247 of Seq ID No 228; 38-50, 53-63, 78-87, 89-111, 126-152, 169-176, 179-186, 193-228, 254-267, 275-282, 288-304, 309-318, 325-341, 346-353, 358-367, 384-395, 404-427, 429-435, 456-465, 467-501, 510-521, 523-536, 541-548, 552-560, 563-584, 589-595, 597-620, 625-637, 639-645, 661-666, 712-729, 734-741, 743-750, 775-806, 809-816, 818-840, 842-850 and 693-714 of Seq ID No 229; 5-17, 30-37, 52-75, 77-86, 88-107, 112-135, 151-160, 178-222, 226-246, 263-270, 279-294, 306-314, 327-342, 345-352, 374-381, 389-416, 422-429, 435-449, 453-467, 473-500, 512-522, 524-531, 542-549, 552-560, 565-571, 575-586, 594-600, 613-619, 625-633, 635-641, 647-653, 667-674, 680-699, 711-729, 735-741, 764-775, 781-786, 792-798, 805-813, 817-825, 833-842, 850-855, 860-866, 869-910, 917-930, 949-990 and 533-562 of Seq ID No 230; 7-14, 39-46, 61-74, 83-89, 93-99, 110-121, 136-150, 172-180, 182-200, 207-216, 223-236, 238-251, 265-271, 280-288, 294-309, 320-336, 339-354, 362-377, 383-389, 401-407, 435-441, 446-453, 460-465, 472-487, 499-511, 518-528, 533-540, 557-570, 572-587, 631-637, 643-658, 663-669, 672-678, 681-687, 695-706, 714-728 and 118-139 of Seq ID No 231; 5-19, 24-30, 56-64, 69-79, 93-100, 102-111, 117-123, 125-133, 174-182, 185-199, 205-224, 268-275, 311-336 and 102-125 of Seq ID No 232; 6-35, 39-45, 57-62, 80-85, 92-106, 117-122, 126-171, 214-223, 253-260, 268-273, 285-291, 295-306, 315-320, 325-336, 361-366 and 172-202 of Seq ID No 233; 4-13, 24-37, 45-51, 58-66, 84-92, 112-121, 132-141, 151-171, 175-195, 204-212, 222-240, 262-268, 276-295, 305-336, 338-348, 354-362 and 160-183 of Seq ID No 234; 10-16, 24-35, 41-73, 78-104, 111-121, 124-139, 141-148, 150-164, 196-215, 224-241, 249-282, 299-307, 315-357, 368-378, 393-401 and 345-367 of Seq ID No 235; 4-32, 48-53, 61-67, 84-104, 112-118 and 106-130 of Seq ID No 236; 21-28, 31-36, 65-81, 98-105, 115-121, 123-131, 136-142, 155-161, 177-190 and 201-232 of Seq ID No 237; 4-15, 21-27, 33-39, 42-56, 58-64, 68-82, 84-90, 92-98, 113-122, 146-162, 168-175, 177-189, 191-203, 249-268, 279-285, 287-304, 328-342, 349-358, 371-378, 387-393, 404-413, 419-425, 467-479, 487-498, 513-524, 528-539, 541-565, 572-579, 595-606, 626-635, 637-642 and 612-626 of Seq ID No 238; 7-13, 52-70, 76-82, 97-106, 110-117 and 13-45 of Seq ID No 239; 5-10, 12-48, 59-64, 87-102, 107-128, 131-140, 154-161, 165-171, 173-215 and 54-74 of Seq ID No 240; 4-11, 19-28, 34-40, 74-81, 87-98, 126-147, 163-171, 184-193, 205-213 and 49-124 of Seq ID No 241; 7-14, 23-29, 35-40, 61-67, 99-106, 111-122, 124-133, 135-161, 187-206, 216-229, 236-245, 262-268, 271-280 and 256-273 of Seq ID No 242; 4-13, 17-37, 47-54, 85-99, 105-113, 120-132, 147-166, 180-186, 192-199, 204-216 and 127-144 of Seq ID No 243; 14-27, 29-37, 52-62, 68-76, 89-96, 117-123, 125-131, 137-145, 166-195, 205-212, 214-222, 228-235, 258-264, 271-281, 288-296, 308-324, 332-339, 355-361, 365-371 and 268-293 of Seq ID No 244; 4-21, 30-42, 54-60, 78-85, 90-110, 141-147, 160-168, 176-185, 194-206, 218-225, 230-245, 251-261, 287-293, 295-304, 320-326, 334-347, 351-362, 386-402, 413-423, 427-433, 439-453, 456-477, 480-493, 507-513, 526-539, 574-581, 591-598, 600-609, 614-632, 655-665, 685-691, 703-712, 742-747, 757-775, 797-803, 813-819, 823-829, 880-887, 901-906, 930-944, 948-958, 962-968, 971-995, 1002-1009, 1017-1023, 1036-1053, 1069-1081, 1107-1124, 1129-1152, 1178-1195, 1211-1223, 1249-1266, 1271-1288, 1334-1340, 1346-1367, 1-63 and 171-189 of Seq ID No 245; 4-22, 52-63, 70-75, 94-104, 112-125, 133-141, 176-199, 209-216, 244-259, 287-299, 336-352, 366-372, 386-399, 421-436, 444-449, 457-466, 481-487, 506-529, 531-540 and 295-378 of Seq ID No 246; 9-30, 43-49, 58-75, 86-96, 119-131, 138-147, 162-167, 181-201, 208-214 and 16-121 of Seq ID No 247; 4-27, 52-58, 80-90, 92-100, 108-114, 118-143, 169-176, 189-198, 247-261, 281-287, 307-317, 323-329, 352-363, 372-381, 396-411, 413-426, 429-440, 442-450, 456-461, 468-479 and 1-73 of Seq ID No 248; 4-32, 47-52, 57-63, 71-78, 92-104, 126-142, 153-175 and 145-163 of Seq ID No 249; 17-23, 35-41, 51-70, 73-86, 104-125 and 105-129 of Seq ID No 250; 25-32, 41-50, 75-85, 87-103, 115-122, 138-149, 164-171, 188-210, 212-220, 224-234, 256-273, 288-299, 304-310, 330-336, 357-365, 382-390, 399-405, 414-421, 440-446, 454-461, 480-486, 502-514, 518-540, 543-553, 561-567, 572-580, 582-588, 595-630, 633-651, 672-681, 691-709, 760-767, 813-832, 841-848, 852-866, 873-893, 919-925, 927-933, 940-955, 957-978, 984-997, 1000-1010, 1035-1040, 1044-1051, 1058-1064, 1081-1091, 1097-1124, 1129-1138, 1144-1150, 1158-1165, 1170-1180, 909-936 and 1001-1031 of Seq ID No 251; 4-12, 19-26, 31-41, 49-64, 66-86, 101-117, 119-127, 134-142, 152-161, 163-172, 179-188, 209-218, 234-241, 276-291, 294-300, 307-320, 324-341, 346-356, 373-387, 389-397, 410-416, 418-436, 444-454, 460-472, 481-486, 500-507, 511-535, 541-549, 553-559, 579-586, 602-607, 613-620, 628-640, 654-663, 671-678, 681-691, 709-722, 741-754, 766-774, 778-786, 797-803 and 212-226 of Seq ID No 252; 4-10, 15-27, 34-54, 60-73, 79-88, 101-115, 120-136, 154-162, 167-172, 222-240 and 126-195 of Seq ID No 253; 5-16, 18-25, 29-35, 57-63, 86-91, 107-121, 123-131, 170-179, 185-199, 204-226, 250-255, 262-274, 291-296, 325-347 and 1-38 of Seq ID No 254; 7-19, 22-34, 36-42, 48-54, 60-66, 71-76, 104-110, 118-133, 135-145, 158-164, 167-174, 182-193, 196-204, 217-229, 251-290, 293-299, 309-315 and 288-318 of Seq ID No 255; 43-51, 55-61, 66-73, 80-90, 103-127, 133-142, 174-180, 185-196, 203-210, 229-235, 239-251, 258-266, 272-278, 289-314, 316-326, 340-346, 355-361 and 14-27 of Seq ID No 256; 4-25, 27-33, 35-41, 52-74, 76-89, 99-124, 138-144, 146-159, 167-182, 184-191, 193-206, 211-223, 232-240, 249-257, 270-279, 281-287, 293-310, 322-341, 347-356 and 292-322 of Seq ID No 257; 5-13, 28-38, 43-60, 67-72, 98-116, 122-134, 137-151, 167-174, 177-195, 197-216 and 99-195 of Seq ID No 258; 15-33, 35-42, 48-57, 62-68, 73-91, 107-119, 121-153, 173-194, 205-210, 223-228, 234-241, 243-259, 275-298, 308-315, 327-340, 342-370, 376-391, 398-404, 410-419 and 71-122 of Seq ID No 259; 12-39, 43-64, 87-95, 99-105, 114-126, 128-136, 139-147, 212-225 and 107-141 of Seq ID No 260; 6-33, 40-45, 60-75, 79-86, 121-129, 131-137, 161-167, 172-178, 186-195, 203-212, 236-244, 257-264, 278-294, 306-312, 345-358, 368-381, 386-395, 404-410, 412-418 and 198-270 of Seq ID No 261; 18-31, 34-41, 50-56, 69-83, 99-106, 129-141, 147-153, 159-168, 170-178, 190-198, 200-212, 221-232, 237-255, 261-266, 274-292 and 118-216 of Seq ID No 262; 17-47, 61-67, 87-93, 115-121, 126-132, 140-148, 167-173, 179-186, 214-223, 250-255, 264-272, 282-294, 306-318, 338-353, 358-377, 385-401, 414-420, 433-441, 451-457, 470-480, 505-511, 544-550, 571-581, 600-607, 612-618, 631-648, 655-662, 669-681, 693-714, 721-726, 733-740, 757-778, 813-823, 831-838, 851-857, 866-876, 893-905, 912-917, 930-936, 951-963, 971-981, 1008-1019, 1021-1033, 1035-1041, 1054-1064, 1066-1076, 1097-1110, 1113-1121, 1126-1140, 1159-1171, 1182-1195, 1197-1203, 1216-1222, 1231-1240, 1243-1262, 1268-1287 and 738-828 of Seq ID No 263; 19-28, 40-46, 51-57, 68-74, 81-87, 98-108, 111-121 and 20-36 of Seq ID No 264; 4-17, 19-44, 60-69, 80-86, 110-116 and 33-60 of Seq ID No 265; 8-16, 18-28, 42-50, 53-75, 79-86, 94-99, 122-128, 136-142, 149-163, 166-173, 198-212, 254-272, 288-295, 304-318, 324-329, 343-348, 351-364, 367-383, 389-395, 411-420, 427-436 and 11-56 of Seq ID No 266; 19-25 and 6-24 of Seq ID No 267; 6-39, 59-68 and 44-63 of Seq ID No 268; 5-14, 21-28, 38-53 and 29-41 of Seq ID No 269; 4-13, 31-41, 56-65 and 32-56 of Seq ID No 270; 5-12 and 4-21 of Seq ID No 271; 4-18 and 17-32 of Seq ID No 272; 4-10, 23-33 and 14-30 of Seq ID No 273; 26-34, 44-53 and 35-52 of Seq ID No 274; 1-19 of Seq ID No 275; 4-17, 23-30, 32-37 and 6-23 of Seq ID No 276; 5-33, 40-58, 61-66 and 45-66 of Seq ID No 277; 15-41, 61-67 and 41-65 of Seq ID No 278; 4-12, 16-23, 26-37 and 10-29 of Seq ID No 279; 23-39 and 37-55 of Seq ID No 280; 12-20 and 38-55 of Seq ID No 281; 22-37 and 7-22 of Seq ID No 282; 3-14 of Seq ID No 283; 6-16, 43-65, 71-76 and 17-31 of Seq ID No 284; 4-13, 27-39, 42-69 and 17-32 of Seq ID No 285; 4-12, 26-39 and 10-25 of Seq ID No 286; 2-31 of Seq ID No 287; 6-38, 49-62 and 39-55 of Seq ID No 288; 4-10, 24-30 and 2-19 of Seq ID No 289; 12-17, 25-46 and 15-30 of Seq ID No 290; 4-13 and 2-28 of Seq ID No 291; 30-38 and 17-45 of Seq ID No 292; 24-33, 55-61 and 31-61 of Seq ID No 293; 4-26, 34-48 and 15-33 of Seq ID No 294; 9-15 and 1-22 of Seq ID No 295; 4-31 and 14-33 of Seq ID No 296; 5-34, 49-55, 64-82 and 69-83 of Seq ID No 297; 33-45 and 21-39 of Seq ID No 298; 7-14, 24-32, 42-65, 79-86 and 50-64 of Seq ID No 299; 13-27, 33-43, 45-62 and 12-37 of Seq ID No 300; 4-15, 17-32 and 10-26 of Seq ID No 301; 4-9, 11-43, 45-75 and 47-69 of Seq ID No 302; 4-18, 22-37 and 17-34 of Seq ID No 303; 4-14 and 5-24 of Seq ID No 304; 7-33, 35-46 and 1-19 of Seq ID No 305; 13-37, 69-75 and 51-69 of Seq ID No 306; 14-24, 26-34, 37-49, 66-78 and 2-25 of Seq ID No 307; 17-46, 52-57, 59-64 and 54-68 of Seq ID No 308; 4-22 and 13-25 of Seq ID No 309; 8-40, 53-63 and 29-50 of Seq ID No 310; 16-28 and 32-40 of Seq ID No 311; 14-20, 22-28, 39-45 and 2-22 of Seq ID No 312; 4-13 and 12-31 of Seq ID No 313; 15-21 and 2-17 of Seq ID No 314; 4-17 and 20-36 of Seq ID No 315; 4-19 and 9-18 of Seq ID No 316; 4-14 and 3-19 of Seq ID No 317; 4-21, 32-40 and 21-39 of Seq ID No 318; 4-13 and 10-27 of Seq ID No 319; 18-31, 39-47, 75-87, 89-98 and 79-99 of Seq ID No 320; 15-21 and 9-24 of Seq ID No 321; 4-14, 18-27, 30-53, 55-64, 68-74, 81-98 and 22-40 of Seq ID No 322; 7-24, 44-51 and 35-60 of Seq ID No 323; 10-47 and 23-37 of Seq ID No 324; 4-10, 12-46 and 7-22 of Seq ID No 325; 20-27 and 1-13 of Seq ID No 326; 6-19, 41-51 and 9-37 of Seq ID No 327; 4-9, 11-17 and 9-23 of Seq ID No 328; 4-17, 23-38, 46-56, 68-85 and 34-46 of Seq ID No 329; 4-18, 34-59, 75-81 and 61-84 of Seq ID No 330; 6-17 and 7-28 of Seq ID No 331; 4-32, 56-61 and 35-52 of Seq ID No 332; 4-14, 27-71, 74-88, 93-110, 115-120, 124-130, 139-154, 161-172 and 146-171 of Seq ID No 333; 4-21 and 3-15 of Seq ID No 334; 12-17 and 9-26 of Seq ID No 335; 10-21, 45-58 and 51-67 of Seq ID No 336; 59-66, 68-84 and 13-42 of Seq ID No 337; 11-16 and 1-16 of Seq ID No 338; 4-19, 23-37 and 10-30 of Seq ID No 339; 19-27, 35-46, 48-66, 82-88, 99-105, 113-119 and 42-59 of Seq ID No 340; 135-147 of Seq ID No 171; 658-682 of Seq ID No 172; 411-427 and 1226-1246 of Seq ID No 173; 794-817 and 801-824 of Seq ID No 174; 468-492 and 474-495 of Seq ID No 177; 366-388 of Seq ID No 178; 266-291, 287-312 and 308-333 of Seq ID No 179; 197-213 and 195-211 of Seq ID No 180; 252-275, 262-285 and 812-830 of Seq ID No 181; 94-112, 97-120 and 104-128 of Seq ID No 182; 257-281 of Seq ID No 183; 106-134 of Seq ID No 184; 70-86 of Seq ID No 187; 358-383, 378-402, 397-421, 499-524, 520-545, 541-566, 622-646, 641-665 and 660-684 of Seq ID No 189; 248-260 of Seq ID No 192; 15-34 of Seq ID No 194; 112-129 of Seq ID No 195; 333-358 and 353-378 of Seq ID No 196; 316-343, 339-366 and 362-389 of Seq ID No 197; 98-123 and 104-126 of Seq ID No 198; 20-43 and 23-48 of Seq ID No 201; 124-145 of Seq ID No 203; 717-738 of Seq ID No 204; 37-56 of Seq ID No 205; 118-134 of Seq ID No 206; 500-522 of Seq ID No 208; 32-47 of Seq ID No 211; 25-51, 47-73 and 69-95 of Seq ID No 212; 503-529 of Seq ID No 215; 112-128 of Seq ID No 216; 181-199 of Seq ID No 218; 109-121 of Seq ID No 219; 150-163 of Seq ID No 220; 77-97 of Seq ID No 221; 564-586 of Seq ID No 223; 75-94 of Seq ID No 224; 776-798, 784-808 and 794-815 of Seq ID No 225; 196-212, 78-100 and 85-107 of Seq ID No 226; 536-553 of Seq ID No 230; 102-125 of Seq ID No 232; 178-198 of Seq ID No 233; 612-626 of Seq ID No 238; 171-187 of Seq ID No 245; 296-320, 315-339, 334-358 and 353-377 of Seq ID No 246; 47-71 of Seq ID No 247; 1-25, 20-45 and 40-64 of Seq ID No 248; 146-161 of Seq ID No 249; 910-935 and 1007-1030 of Seq ID No 251; 212-226 of Seq ID No 252; 126-152, 148-173 and 169-195 of Seq ID No 253; 288-310 and 293-316 of Seq ID No 255; 293-312 of Seq ID No 257; 154-170 of Seq ID No 258; 72-95, 90-112 and 97-121 of Seq ID No 259; 135-150 and 146-163 of Seq ID No 262; 799-827 of Seq ID No 263; 23-43 and 33-53 of Seq ID No 266; 44-62 of Seq ID No 268; 6-22 of Seq ID No 276; 37-54 of Seq ID No 280; 40-54 of Seq ID No 281; 7-21 of Seq ID No 282; 4-11, 16-34, 48-55, 67-77, 87-106 and 153-183 of Seq ID No 425; 22-40, 49-65, 70-91, 95-109, 111-125, 146-207, 209-216, 219-225, 229-244, 251-270, 274-286, 292-309, 316-329, 335-355, 358-370, 376-388, 392-419, 425-430, 435-441, 448-455, 464-478, 486-515 and 437-465 of Seq ID No 426; 5-19, 25-31, 43-48, 60-79, 88-100, 105-129, 148-171, 187-193, 243-263, 316-322, 334-340, 345-351, 369-378, 381-391, 399-404, 474-483, 502-517, 525-530, 558-568, 579-596, 622-627, 631-638, 644-651, 653-660, 674-680, 687-693, 721-728, 743-753, 760-775, 788-795, 806-813, 821-828, 835-842, 847-859, 868-887 and 300-347 of Seq ID No 427; 5-26, 37-44, 89-97, 112-118, 121-128, 138-154, 157-165, 176-181, 188-198, 205-218, 223-243, 247-253, 260-279 and 76-155 of Seq ID No 428; 4-29, 41-46, 49-68, 82-88, 121-147, 158-164, 187-193, 195-208, 229-236, 244-249, 251-263, 269-275, 307-313, 337-343, 348-381, 392-398, 402-408, 432-438, 85-117 and 194-239 of Seq ID No 429; 5-12, 14-22, 28-34, 40-46, 70-79, 84-129, 152-165, 174-182 and 37-109 of Seq ID No 430; 5-16, 18-52, 54-72, 81-86, 118-126, 136-145, 151-157, 168-180, 209-233, 244-270, 295-302, 315-326, 329-337, 345-352, 364-373, 397-402, 408-418, 424-431, 435-443, 472-480, 483-489, 504-510, 519-527, 549-564, 576-599, 605-637, 641-673 and 91-98 of Seq ID No 431; 23-36, 42-52, 133-140, 151-157, 242-247, 267-277, 295-301, 320-328, 333-339, 345-352, 365-371, 397-403, 415-428, 456-465, 481-487, 489-495, 508-516, 518-527, 585-592, 606-614, 631-637, 643-658, 665-670, 723-728, 737-744, 752-759, 787-793, 835-841, 873-885, 918-928, 938-945, 951-966, 978-988, 1015-1020, 1030-1036, 1044-1052, 1058-1069, 1071-1079, 1081-1088, 1113-1119, 1125-1138, 1141-1147, 1164-1170, 1172-1177, 1190-1200, 1214-1220, 1230-1236, 1239-1245, 1262-1268, 1270-1275, 1288-1298, 1312-1318, 1328-1334, 1337-1343, 1360-1366, 1368-1373, 1386-1396, 1410-1416, 1426-1432, 1435-1441, 1458-1464, 1466-1471, 1484-1494, 1508-1514, 1524-1530, 1533-1539, 1556-1562 and 307-340 of Seq ID No 432; 19-25, 35-41, 44-50, 66-72, 74-79, 92-102, 116-122, 132-138, 141-147, 164-170, 172-177, 190-200, 214-220, 230-236, 239-245, 262-268, 270-275, 288-298, 312-318, 328-334, 337-343, 360-366, 368-373, 386-396, 410-416, 426-432, 435-441, 458-464, 466-478, 504-524, 79-148, 177-246, 275-344 and 373-442 of Seq ID No 433; 7-14, 16-23, 33-39, 46-53, 72-79, 92-115, 123-130, 156-175, 179-187, 214-220, 239-246, 266-274, 302-325, 338-354, 360-370, 375-390, 392-401, 421-428, 430-463 and 29-58 of Seq ID No 434; 4-9, 22-39, 58-65, 72-82, 87-92, 99-104, 107-119, 143-

166, 171-177, 194-202, 205-213, 220-228, 231-240, 247-263, 309-315, 317-323, 336-343 and 294-320 of Seq ID No 435; 4-10, 12-18, 24-29, 34-43, 50-65, 70-76, 111-117, 129-138, 152-159, 166-171, 184-195, 200-210, 224-236, 241-251, 274-283, 285-296, 313-319, 332-341, 348-355, 378-386, 410-416, 433-445, 475-482, 523-529, 531-540, 584-596, 626-633, 674-680, 682-688, 738-750, 780-787, 828-834, 836-842, 853-862, 882-887, 893-912 and 604-676 of Seq ID No 436; 15-38, 49-57, 60-99, 103-119, 124-194, 200-206, 215-249, 251-291, 307-313, 315-347, 369-378, 383-390, 393-400, 405-411, 423-435, 440-447, 454-460, 470-486, 490-503, 532-539, 542-549, 551-567, 579-592 and 509-583 of Seq ID No 437; 38-44, 47-88, 95-103, 157-172, 235-240, 250-260, 263-276, 294-300, 312-317, 331-337, 369-391, 412-419, 442-448, 453-463, 490-529, 537-555, 571-580, 600-617, 619-627, 642-648, 682-687, 693-700, 716-722, 738-748, 756-763, 779-789, 796-802, 820-828, 833-840, 846-853, 862-872, 880-887, 894-899, 924-937, 957-963, 1006-1012, 1043-1049, 1063-1069, 1076-1097 and 124-147 of Seq ID No 438; 4-28, 31-49, 60-71, 75-102, 104-114, 134-144, 160-184, 250-257, 277-285, 287-294, 330-338, 345-351, 367-374, 381-388, 393-399, 402-407, 420-426, 443-448, 458-464, 411-436 and 454-488 of Seq ID No 439; 20-27, 45-55, 57-64, 66-77, 98-106, 130-137, 155-165, 167-174, 176-187, 194-203, 208-223, 227-238, 245-251, 257-270, 273-278, 287-299, 330-345, 352-358, 363-385, 392-399, 410-417, 437-443, 467-484, 486-492, 495-500, 504-516, 526-536 and 219-270 of Seq ID No 440; 11-22, 24-31, 46-63, 65-71, 73-88, 95-109, 174-181, 183-201, 204-212, 216-222, 228-233, 241-247 and 142-221 of Seq ID No 441; 8-28, 51-59, 67-84, 93-98, 140-152, 154-162, 183-188 and 91-125 of Seq ID No 442; 10-22, 27-61 and 69-100 of Seq ID No 443; 7-15, 18-26, 94-100, 126-131, 152-165, 219-228, 254-263, 274-292, 297-308, 333-340, 342-352, 354-371, 373-379, 403-410, 420-438, 450-456, 463-470, 489-495, 503-512 and 97-173 of Seq ID No 444; 4-21, 37-43, 49-65, 67-74, 76-90, 113-119, 131-141, 155-173, 175-189, 192-199, 207-221, 247-254, 266-276, 317-322, 337-343, 387-393, 408-428, 439-448, 451-460, 469-479, 482-487, 493-501, 517-523, 533-542 and 480-503 of Seq ID No 445; 11-26, 40-46, 78-86, 93-103, 121-126, 132-138, 166-177, 183-196, 203-212, 214-221, 228-263, 304-311, 323-338, 345-351, 357-363, 379-393, 420-434, 442-448, 518-527, 547-553, 581-591, 602-609, 637-645, 665-674, 687-692, 701-708, 730-739, 796-802, 844-857, 882-888, 903-914, 944-950, 976-983, 1027-1033, 1049-1057, 1066-1072, 1085-1092, 1120-1127, 1137-1144, 1153-1158, 1165-1176, 1181-1187, 1221-1230, 1238-1244, 1269-1274 and 605-632 of Seq ID No 446; 6-47, 57-65, 83-95, 109-121, 138-147, 154-164, 167-177, 194-200, 202-212, 227-234, 240-253, 260-267, 283-291, 320-329, 340-347, 356-364, 412-422, 430-436, 441-459, 465-475, 478-486, 498-507 and 59-84 of Seq ID No 447; 10-21, 58-83, 88-97, 120-126 and 21-51 of Seq ID No 448; 5-39, 56-62, 76-88, 90-114, 138-162, 170-195, 202-221, 228-250, 264-270, 304-355, 374-387, 391-416, 462-471, 526-546, 554-561, 574-579, 639-645, 651-660, 674-682, 689-694 and 666-697 of Seq ID No 449; 6-30, 36-42, 143-157, 176-197, 202-209, 216-233, 241-246, 275-287, 292-299, 315-325, 343-350, 375-380, 397-403, 411-420, 422-434, 441-448, 467-474, 477-499, 555-568, 591-597, 601-609, 623-644, 667-688, 692-698, 703-718, 736-747, 757-766, 782-791, 795-801, 832-840, 859-865 and 226-269 of Seq ID No 450; 6-23, 43-51, 61-67, 73-82, 91-97, 123-130, 149-158, 164-175, 228-234, 240-246, 248-255, 262-272, 326-332, 340-347, 365-371, 377-388, 409-419, 425-431, 438-445, 449-457, 464-470, 496-507, 559-568, 575-581, 603-608, 617-623, 633-639, 648-654, 659-670, 695-701, 734-752, 806-814, 816-829, 861-868, 891-899, 904-909, 937-945, 947-960, 978-983, 992-999, 1022-1031, 1068-1076, 1078-1091, 1109-1114, 1123-1130, 1153-1162, 1199-1207, 1209-1222, 1254-1261, 1284-1293, 1330-1338, 1340-1353, 1371-1376, 1385-1392, 1415-1421, 1433-1438, 1460-1465, 1470-1492 and 1422-1458 of Seq ID No 451; 82-94, 111-118, 125-131, 206-212, 261-266, 310-320, 328-338, 345-351, 353-360, 414-420, 424-434, 440-447, 451-500, 506-516, 548-561, 566-572, 584-591, 601-622, 630-636, 650-659, 661-667, 674-699, 703-711, 717-729, 736-744, 752-759, 765-771, 813-822, 826-842, 852-868, 870-877, 881-895, 897-906, 913-922 and 602-671 of Seq ID No 452; 12-18, 20-25, 43-54, 56-65, 73-79, 82-88, 99-111, 136-142, 153-169, 171-183, 195-223, 229-248, 255-260, 272-277, 281-292, 298-319, 322-329, 332-351, 363-379, 381-389 and 275-304 of Seq ID No 453; 4-9, 34-48, 65-77, 101-106, 111-131, 138-153, 186-191, 230-250 and 148-219 of Seq ID No 454; 4-23, 30-35, 42-53, 67-76, 82-87, 101-108, 112-130, 132-138, 147-152, 161-183, 187-208, 218-225, 265-283, 295-303, 306-317, 322-334, 338-357, 360-368, 370-383, 387-398, 400-419, 421-430, 104-182 and 240-304 of Seq ID No 455; 4-12, 63-69, 94-102, 146-164, 166-173, 175-181, 193-207, 263-281, 286-295, 301-306, 330-343, 369-378, 382-388, 414-420, 422-430, 438-454, 456-462, 472-531, 543-560, 581-591, 596-605, 614-623, 626-635, 656-662, 669-676, 683-690, 693-698, 705-711, 728-736, 752-764 and 69-102 of Seq ID No 456; 6-12, 43-53, 141-147, 164-179, 185-195, 197-206, 227-235, 237-271, 288-305, 308-317, 335-341, 351-357, 365-376, 386-395, 397-416, 422-447 and 11-35 of Seq ID No 457; 16-24, 50-65, 73-84, 88-99, 114-124, 130-146, 181-187, 193-203, 214-220, 236-247, 250-258, 287-297 and 50-113 of Seq ID No 458; 4-25, 50-55, 76-82, 117-123, 131-137, 139-148, 157-166, 239-245, 253-258, 266-275, 277-292, 300-306, 51-83 and 93-161 of Seq ID No 459; 6-22, 34-43, 51-86, 93-100, 110-116, 150-161, 164-171, 180-187, 197-218 and 168-237 of Seq ID No 460; 4-27, 55-60, 74-82 and 10-46 of Seq ID No 461; 6-19, 25-31, 43-49, 60-79, 88-100, 105-129, 148-161, 164-171, 187-193, 243-263, 316-322, 334-340, 369-378, 381-391, 398-404, 460-466, 474-483, 502-509, 511-517, 525-530, 558-567, 579-596, 622-627, 631-638, 641-651, 653-659, 674-680, 687-693, 710-716, 720-727, 743-753, 760-775, 788-795, 806-813, 821-828, 836-842, 847-860, 865-880 and 258-377 of Seq ID No 462; 4-11, 25-64, 71-79, 88-94, 107-120, 123-132, 167-188, 231-237, 240-246, 261-267, 306-311, 330-342, 351-358, 389-395, 406-418, 429-434, 439-448, 483-501, 511-520 and 71-143 of Seq ID No 463; 4-18, 22-27, 53-64, 94-100, 121-127, 133-139, 155-164, 177-182, 187-196, 206-218, 224-242, 248-253, 258-277 and 184-253 of Seq ID No 464; 10-17, 56-67, 72-82, 94-99, 106-113, 166-173, 229-235, 243-283, 295-301, 313-321, 326-331, 342-348, 396-414, 423-435, 446-452, 454-462, 496-502, 511-534, 543-556, 563-570, 586-593, 616-626, 638-645, 653-662, 679-696, 731-737, 766-774, 776-782, 790-796, 810-817, 825-835, 837-846 and 540-615 of Seq ID No 465; 13-24, 30-36, 73-81, 89-95, 109-115, 117-143, 161-173, 179-189, 226-244, 251-261, 275-281, 298-305, 307-315, 323-328, 364-374, 69-186 and 264-354 of Seq ID No 466; 19-25 and 6-22 of Seq ID No 467; 6-39, 59-68 and 43-62 of Seq ID No 468; 6-14, 22-32 and 1-27 of Seq ID No 469; 4-41 and 28-40 of Seq ID No 470; 8-14 and 4-19 of Seq ID No 471; 4-10, 12-22, 30-35 and 6-33 of Seq ID No 472; 4-16, 24-33 and 37-54 of Seq ID No 473; 2-23 of Seq ID No 474; 4-21, 27-33, 36-41 and 14-34 of Seq ID No 475; 4-14, 24-30, 37-42, 57-78, 83-89, 94-103, 113-131 and 100-122 of Seq ID No 476, and fragments comprising at least 6, preferably more than 8, especially more than 10 aa and preferably not more than 70, 50, 40, 20, 15, 11 aa of said sequences. All these fragments individually and each independently form a preferred selected aspect of the present invention.

All linear hyperimmune serum reactive fragments of a particular antigen may be identified by analysing the entire sequence of the protein antigen by a set of peptides overlapping by 1 amino acid with a length of at least 10 amino acids. Subsequently, non-linear epitopes can be identified by analysis of the protein antigen with hyperimmune sera using the expressed full-length protein or domain polypeptides thereof. Assuming that a distinct domain of a protein is sufficient to form the 3D structure independent from the native protein, the analysis of the respective recombinant or synthetically produced domain polypeptide with hyperimmune serum would allow the identification of conformational epitopes within the individual domains of multi-domain proteins. For those antigens where a domain possesses linear as well as conformational epitopes, competition experiments with peptides corresponding to the linear epitopes may be used to confirm the presence of conformational epitopes.

It will be appreciated that the invention also relates to, among others, nucleic acid molecules encoding the aforementioned fragments, nucleic acid molecules that hybridise to nucleic acid molecules encoding the fragments, particularly those that hybridise under stringent conditions, and nucleic acid molecules, such as PCR primers, for amplifying nucleic acid molecules that encode the fragments. In these regards, preferred nucleic acid molecules are those that correspond to the preferred fragments, as discussed above.

The present invention also relates to vectors which comprise a nucleic acid molecule or nucleic acid molecules of the present invention, host cells which are genetically engineered with vectors of the invention and the production of hyperimmune serum reactive antigens and fragments thereof by recombinant techniques.

A great variety of expression vectors can be used to express a hyperimmune serum reactive antigen or fragment thereof according to the present invention. Generally, any vector suitable to maintain, propagate or express nucleic acids to express a polypeptide in a host may be used for expression in this regard. In accordance with this aspect of the invention the vector may be, for example, a plasmid vector, a single or double-stranded phage vector, a single or double-stranded RNA or DNA viral vector. Starting plasmids disclosed herein are either commercially available, publicly available, or can be constructed from available plasmids by routine application of well-known, published procedures. Preferred among vectors, in certain respects, are those for expression of nucleic acid molecules and hyperimmune serum reactive antigens or fragments thereof of the present invention. Nucleic acid constructs in host cells can be used in a conventional manner to produce the gene product encoded by the recombinant sequence. Alternatively, the hyperimmune serum reactive antigens and fragments thereof of the invention can be synthetically produced by conventional peptide synthesizers. Mature proteins can be expressed in mammalian cells, yeast, bacteria, or other cells under the control of appropriate promoters. Cell-free translation systems can also be employed to produce such proteins using RNAs derived from the DNA construct of the present invention.

Host cells can be genetically engineered to incorporate nucleic acid molecules and express nucleic acid molecules of the present invention. Representative examples of appropriate hosts include bacterial cells, such as enterococci, staphylococci, *E. coli*, *Streptomyces* and *Bacillus subtillis* cells; fungal cells, such as yeast cells and *Aspergillus* cells; insect cells such as *Drosophila* S2 and *Spodoptera* Sf9 cells; animal cells such as CHO, COS, Hela, C127, 3T3, BHK, 293 and Bowes melanoma cells; and plant cells.

The invention also provides a process for producing a *E. faecalis* hyperimmune serum reactive antigen and a fragment thereof comprising expressing from the host cell a hyperimmune serum reactive antigen or fragment thereof encoded by the nucleic acid molecules provided by the present invention. The invention further provides a process for producing a cell, which expresses a *E. faecalis* hyperimmune serum reactive antigen or a fragment thereof comprising transforming or transfecting a suitable host cell with the vector according to the present invention such that the transformed or transfected cell expresses the polypeptide encoded by the nucleic acid contained in the vector.

The polypeptide may be expressed in a modified form, such as a fusion protein, and may include not only secretion signals but also additional heterologous functional regions. Thus, for instance, a region of additional amino acids, particularly charged amino acids, may be added to the N- or C-terminus of the polypeptide to improve stability and persistence in the host cell, during purification or during subsequent handling and storage. Also, regions may be added to the polypeptide to facilitate purification. Such regions may be removed prior to final preparation of the polypeptide. The addition of peptide moieties to polypeptides to engender secretion or excretion, to improve stability or to facilitate purification, among others, are familiar and routine techniques in the art. A preferred fusion protein comprises a heterologous region from immunoglobulin that is useful to solubilize or purify polypeptides. For example, EP-A-0 464 533 (Canadian counterpart 2045869) discloses fusion proteins comprising various portions of constant region of immunoglobin molecules together with another protein or part thereof. In drug discovery, for example, proteins have been fused with antibody Fc portions for the purpose of high-throughput screening assays to identify antagonists. See for example, {Bennett, D. et al., 1995} and {Johanson, K. et al., 1995}.

The *E. faecalis* hyperimmune serum reactive antigen or a fragment thereof can be recovered and purified from recombinant cell cultures by well-known methods including ammonium sulfate or ethanol precipitation, acid extraction, anion or cation exchange chromatography, phosphocellulose chromatography, hydrophobic interaction chromatography, hydroxylapatite chromatography and lectin chromatography.

The hyperimmune serum reactive antigens and fragments thereof according to the present invention can be produced by chemical synthesis as well as by biotechnological means. The latter comprise the transfection or transformation of a host cell with a vector containing a nucleic acid according to the present invention and the cultivation of the transfected or transformed host cell under conditions which are known to the ones skilled in the art. The production method may also comprise a purification step in order to purify or isolate the polypeptide to be manufactured. In a preferred embodiment the vector is a vector according to the present invention.

The hyperimmune serum reactive antigens and fragments thereof according to the present invention may be used for the detection of the organism or organisms in a sample containing these organisms or polypeptides derived thereof. Preferably such detection is for diagnosis, more preferable for the diagnosis of a disease, most preferably for the diagnosis of a diseases related or linked to the presence or abundance of Gram-positive bacteria, especially bacteria selected from the group comprising enterococci, staphylococci and lactococci. More preferably, the microorganisms are selected from the group comprising *Streptococcus agalactiae*, *Streptococcus*

*pneumoniae* and *Streptococcus mutans*, especially the microorganism is *Enterococcus faecalis*.

The present invention also relates to diagnostic assays such as quantitative and diagnostic assays for detecting levels of the hyperimmune serum reactive antigens and fragments thereof of the present invention in cells and tissues, including determination of normal and abnormal levels. Thus, for instance, a diagnostic assay in accordance with the invention for detecting over-expression of the polypeptide compared to normal control tissue samples may be used to detect the presence of an infection, for example, and to identify the infecting organism. Assay techniques that can be used to determine levels of a polypeptide, in a sample derived from a host are well-known to those of skill in the art. Such assay methods include radioimmunoassays, competitive-binding assays, Western Blot analysis and ELISA assays. Among these, ELISAs frequently are preferred. An ELISA assay initially comprises preparing an antibody specific to the polypeptide, preferably a monoclonal antibody. In addition, a reporter antibody generally is prepared which binds to the monoclonal antibody. The reporter antibody is attached to a detectable reagent such as radioactive, fluorescent or enzymatic reagent, such as horseradish peroxidase enzyme.

The hyperimmune serum reactive antigens and fragments thereof according to the present invention may also be used for the purpose of or in connection with an array. More particularly, at least one of the hyperimmune serum reactive antigens and fragments thereof according to the present invention may be immobilized on a support. Said support typically comprises a variety of hyperimmune serum reactive antigens and fragments thereof whereby the variety may be created by using one or several of the hyperimmune serum reactive antigens and fragments thereof according to the present invention and/or hyperimmune serum reactive antigens and fragments thereof being different. The characterizing feature of such array as well as of any array in general is the fact that at a distinct or predefined region or position on said support or a surface thereof, a distinct polypeptide is immobilized. Because of this any activity at a distinct position or region of an array can be correlated with a specific polypeptide. The number of different hyperimmune serum reactive antigens and fragments thereof immobilized on a support may range from as little as 10 to several 1000 different hyperimmune serum reactive antigens and fragments thereof. The density of hyperimmune serum reactive antigens and fragments thereof per $cm^2$ is in a preferred embodiment as little as 10 peptides/polypeptides per $cm^2$ to at least 400 different peptides/polypeptides per $cm^2$ and more particularly at least 1000 different hyperimmune serum reactive antigens and fragments thereof per $cm^2$.

The manufacture of such arrays is known to the one skilled in the art and, for example, described in U.S. Pat. No. 5,744,309. The array preferably comprises a planar, porous or non-porous solid support having at least a first surface. The hyperimmune serum reactive antigens and fragments thereof as disclosed herein, are immobilized on said surface. Preferred support materials are, among others, glass or cellulose. It is also within the present invention that the array is used for any of the diagnostic applications described herein. Apart from the hyperimmune serum reactive antigens and fragments thereof according to the present invention also the nucleic acid molecules according to the present invention may be used for the generation of an array as described above. This applies as well to an array made of antibodies, preferably monoclonal antibodies as, among others, described herein.

In a further aspect the present invention relates to an antibody directed to any of the hyperimmune serum reactive antigens and fragments thereof, derivatives or fragments thereof according to the present invention. The present invention includes, for example, monoclonal and polyclonal antibodies, chimeric, single chain, and humanized antibodies, as well as Fab fragments, or the product of a Fab expression library. It is within the present invention that the antibody may be chimeric, i.e. that different parts thereof stem from different species or at least the respective sequences are taken from different species.

Antibodies generated against the hyperimmune serum reactive antigens and fragments thereof corresponding to a sequence of the present invention can be obtained by direct injection of the hyperimmune serum reactive antigens and fragments thereof into an animal or by administering the hyperimmune serum reactive antigens and fragments thereof to an animal, preferably a non-human. The antibody so obtained will then bind the hyperimmune serum reactive antigens and fragments thereof itself. In this manner, even a sequence encoding only a fragment of a hyperimmune serum reactive antigen and fragments thereof can be used to generate antibodies binding the whole native hyperimmune serum reactive antigen and fragments thereof. Such antibodies can then be used to isolate the hyperimmune serum reactive antigens and fragments thereof from tissue expressing those hyperimmune serum reactive antigens and fragments thereof.

For preparation of monoclonal antibodies, any technique known in the art which provides antibodies produced by continuous cell line cultures can be used (as described originally in {Kohler, G. et al., 1975}).

Techniques described for the production of single chain antibodies (U.S. Pat. No. 4,946,778) can be adapted to produce single chain antibodies to immunogenic hyperimmune serum reactive antigens and fragments thereof according to this invention. Also, transgenic mice, or other organisms such as other mammals, may be used to express humanized antibodies to immunogenic hyperimmune serum reactive antigens and fragments thereof according to this invention.

Alternatively, phage display technology or ribosomal display could be utilized to select antibody genes with binding activities towards the hyperimmune serum reactive antigens and fragments thereof either from repertoires of PCR amplified v-genes of lymphocytes from humans screened for possessing respective target antigens or from naïve libraries {McCafferty, J. et al., 1990}; {Marks, J. et al., 1992}. The affinity of these antibodies can also be improved by chain shuffling {Clackson, T. et al., 1991}.

If two antigen binding domains are present, each domain may be directed against a different epitope—termed 'bispecific' antibodies.

The above-described antibodies may be employed to isolate or to identify clones expressing the hyperimmune serum reactive antigens and fragments thereof or purify the hyperimmune serum reactive antigens and fragments thereof of the present invention by attachment of the antibody to a solid support for isolation and/or purification by affinity chromatography.

Thus, among others, antibodies against the hyperimmune serum reactive antigens and fragments thereof of the present invention may be employed to inhibit and/or treat infections, particularly bacterial infections and especially infections arising from *E. faecalis*.

Hyperimmune serum reactive antigens and fragments thereof include antigenically, epitopically or immunologically equivalent derivatives which form a particular aspect of this invention. The term "antigenically equivalent derivative" as used herein encompasses a hyperimmune serum reactive antigen and fragments thereof or its equivalent which will be specifically recognized by certain antibodies which, when raised to the protein or hyperimmune serum reactive antigen and fragments thereof according to the present invention, interfere with the interaction between pathogen and mammalian host. The term "immunologically equivalent derivative" as used herein encompasses a peptide or its equivalent which when used in a suitable formulation to raise antibodies in a vertebrate, the antibodies act to interfere with the interaction between pathogen and mammalian host.

The hyperimmune serum reactive antigens and fragments thereof, such as an antigenically or immunologically equivalent derivative or a fusion protein thereof can be used as an antigen to immunize a mouse or other animal such as a rat or chicken. The fusion protein may provide stability to the hyperimmune serum reactive antigens and fragments thereof. The antigen may be associated, for example by conjugation, with an immunogenic carrier protein, for example bovine serum albumin (BSA) or keyhole limpet haemocyanin (KLH). Alternatively, an antigenic peptide comprising multiple copies of the protein or hyperimmune serum reactive antigen and fragments thereof, or an antigenically or immunologically equivalent hyperimmune serum reactive antigen and fragments thereof, may be sufficiently antigenic to improve immunogenicity so as to obviate the use of a carrier.

Preferably the antibody or derivative thereof is modified to make it less immunogenic in the individual. For example, if the individual is human the antibody may most preferably be "humanized", wherein the complimentarity determining region(s) of the hybridoma-derived antibody has been transplanted into a human monoclonal antibody, for example as described in {Jones, P. et al., 1986} or {Tempest, P. et al., 1991}.

The use of a polynucleotide of the invention in genetic immunization will preferably employ a suitable delivery method such as direct injection of plasmid DNA into muscle, delivery of DNA complexed with specific protein carriers, coprecipitation of DNA with calcium phosphate, encapsulation of DNA in various forms of liposomes, particle bombardment {Tang, D. et al., 1992}; {Eisenbraun, M. et al., 1993} and in vivo infection using cloned retroviral vectors {Seeger, C. et al., 1984}.

In a further aspect the present invention relates to a peptide binding to any of the hyperimmune serum reactive antigens and fragments thereof according to the present invention, and a method for the manufacture of such peptides whereby the method is characterized by the use of the hyperimmune serum reactive antigens and fragments thereof according to the present invention and the basic steps are known to the one skilled in the art.

Such peptides may be generated by using methods according to the state of the art such as phage display or ribosome display. In case of phage display, basically a library of peptides is generated, in form of phages, and this kind of library is contacted with the target molecule, in the present case a hyperimmune serum reactive antigen and fragments thereof according to the present invention. Those peptides binding to the target molecule are subsequently removed, preferably as a complex with the target molecule, from the respective reaction. It is known to the one skilled in the art that the binding characteristics, at least to a certain extent, depend on the particularly realized experimental set-up such as the salt concentration and the like. After separating those peptides binding to the target molecule with a higher affinity or a bigger force, from the non-binding members of the library, and optionally also after removal of the target molecule from the complex of target molecule and peptide, the respective peptide(s) may subsequently be characterised. Prior to the characterisation optionally an amplification step is realized such as, e.g. by propagating the peptide encoding phages. The characterisation preferably comprises the sequencing of the target binding peptides. Basically, the peptides are not limited in their lengths, however, preferably peptides having a lengths from about 8 to 20 amino acids are preferably obtained in the respective methods. The size of the libraries may be about $10^2$ to $10^{18}$, preferably $10^8$ to $10^{15}$ different peptides, however, is not limited thereto.

A particular form of target binding hyperimmune serum reactive antigens and fragments thereof are the so-called "anticalines" which are, among others, described in German patent application DE 197 42 706.

In a further aspect the present invention relates to functional nucleic acids interacting with any of the hyperimmune serum reactive antigens and fragments thereof according to the present invention, and a method for the manufacture of such functional nucleic acids whereby the method is characterized by the use of the hyperimmune serum reactive antigens and fragments thereof according to the present invention and the basic steps are known to the one skilled in the art. The functional nucleic acids are preferably aptamers and spiegelmers.

Aptamers are D-nucleic acids which are either single stranded or double stranded and which specifically interact with a target molecule. The manufacture or selection of aptamers is, e.g., described in European patent EP 0 533 838. Basically the following steps are realized. First, a mixture of nucleic acids, i.e. potential aptamers, is provided whereby each nucleic acid typically comprises a segment of several, preferably at least eight subsequent randomised nucleotides. This mixture is subsequently contacted with the target molecule whereby the nucleic acid(s) bind to the target molecule, such as based on an increased affinity towards the target or with a bigger force thereto, compared to the candidate mixture. The binding nucleic acid(s) are/is subsequently separated from the remainder of the mixture. Optionally, the thus obtained nucleic acid(s) is amplified using, e.g. polymerase chain reaction. These steps may be repeated several times giving at the end a mixture having an increased ratio of nucleic acids specifically binding to the target from which the final binding nucleic acid is then optionally selected. These specifically binding nucleic acid(s) are referred to as aptamers. It is obvious that at any stage of the method for the generation or identification of the aptamers samples of the mixture of individual nucleic acids may be taken to determine the sequence thereof using standard techniques. It is within the present invention that the aptamers may be stabilized such as, e.g., by introducing defined chemical groups which are known to the one skilled in the art of generating aptamers. Such modification may for example reside in the introduction of an amino group at the 2'-position of the sugar moiety of the nucleotides. Aptamers are currently used as therapeutical agents. However, it is also within the present invention that the thus selected or generated aptamers may be used for target validation and/or as lead substance for the development of medicaments, preferably of medicaments based on small molecules. This is actually done by a competition assay whereby the specific interaction between the target molecule and the aptamer is inhibited by a candidate drug whereby upon replacement of the aptamer from the complex of target and aptamer it may be assumed that the respective drug candidate allows a specific inhibition of the interaction between target and aptamer, and if the interaction is specific, said candidate drug will, at least in principle, be suitable to block the target and thus decrease its biological availability or activity in a respective system comprising such target. The thus obtained small molecule may then be subject to further derivatisation and modification to optimise its physical, chemical, biological and/or medical characteristics such as toxicity, specificity, biodegradability and bioavailability.

Spiegelmers and their generation or manufacture is based on a similar principle. The manufacture of spiegelmers is described in international patent application WO 98/08856. Spiegelmers are L-nucleic acids, which means that they are composed of L-nucleotides rather than D-nucleotides as aptamers are. Spiegelmers are characterized by the fact that they have a very high stability in biological systems and, comparable to aptamers, specifically interact with the target molecule against which they are directed. In the process of generating spiegelmers, a heterogeneous population of D-nucleic acids is created and this population is contacted with the optical antipode of the target molecule, in the present case for example with the D-enantiomer of the naturally occurring L-enantiomer of the hyperimmune serum reactive antigens and fragments thereof according to the present invention. Subsequently, those D-nucleic acids are separated which do not interact with the optical antipode of the target molecule. But those D-nucleic acids interacting with the optical antipode of the target molecule are separated, optionally identified and/or sequenced and subsequently the corresponding L-nucleic acids are synthesized based on the nucleic acid sequence information obtained from the D-nucleic acids. These L-nucleic acids which are identical in terms of sequence with the aforementioned D-nucleic acids interacting with the optical antipode of the target molecule, will specifically interact with the naturally occurring target molecule rather than with the optical antipode thereof. Similar to the method for the generation of aptamers it is also possible to repeat the various steps several times and thus to enrich those nucleic acids specifically interacting with the optical antipode of the target molecule.

In a further aspect the present invention relates to functional nucleic acids interacting with any of the nucleic acid molecules according to the present invention, and a method for the manufacture of such functional nucleic acids whereby the method is characterized by the use of the nucleic acid molecules and their respective sequences according to the present invention and the basic steps are known to the one skilled in the art. The functional nucleic acids are preferably ribozymes, antisense oligonucleotides and siRNA.

Ribozymes are catalytically active nucleic acids which preferably consist of RNA which basically comprises two moieties. The first moiety shows a catalytic activity whereas the second moiety is responsible for the specific interaction with the target nucleic acid, in the present case the nucleic acid coding for the hyperimmune serum reactive antigens and fragments thereof according to the present invention. Upon interaction between the target nucleic acid and the second moiety of the ribozyme, typically by hybridisation and Watson-Crick base pairing of essentially complementary stretches of bases on the two hybridising strands, the catalytically active moiety may become active which means that it catalyses, either intramolecularly or intermolecularly, the target nucleic acid in case the catalytic activity of the ribozyme is a phosphodiesterase activity. Subsequently, there may be a further degradation of the target nucleic acid which in the end results in the degradation of the target nucleic acid as well as the protein derived from the said target nucleic acid. Ribozymes, their use and design principles are known to the one skilled in the art, and, for example described in {Doherty, E. et al., 2001} and {Lewin, A. et al., 2001}.

The activity and design of antisense oligonucleotides for the manufacture of a medicament and as a diagnostic agent, respectively, is based on a similar mode of action. Basically, antisense oligonucleotides hybridise based on base complementarity, with a target RNA, preferably with a mRNA, thereby activating RNase H. RNase H is activated by both phosphodiester and phosphorothioate-coupled DNA. Phosphodiester-coupled DNA, however, is rapidly degraded by cellular nucleases with the exception of phosphorothioate-coupled DNA. These resistant, non-naturally occurring DNA derivatives do not inhibit RNase H upon hybridisation with RNA. In other words, antisense polynucleotides are only effective as DNA RNA hybride complexes. Examples for this kind of antisense oligonucleotides are described, among others, in U.S. Pat. No. 5,849,902 and U.S. Pat. No. 5,989,912. In other words, based on the nucleic acid sequence of the target molecule which in the present case are the nucleic acid molecules for the hyperimmune serum reactive antigens and fragments thereof according to the present invention, either from the target protein from which a respective nucleic acid sequence may in principle be deduced, or by knowing the nucleic acid sequence as such, particularly the mRNA, suitable antisense oligonucleotides may be designed base on the principle of base complementarity.

Particularly preferred are antisense-oligonucleotides which have a short stretch of phosphorothioate DNA (3 to 9 bases). A minimum of 3 DNA bases is required for activation of bacterial RNase H and a minimum of 5 bases is required for mammalian RNase H activation. In these chimeric oligonucleotides there is a central region that forms a substrate for RNase H that is flanked by hybridising "arms" comprised of modified nucleotides that do not form substrates for RNase H. The hybridising arms of the chimeric oligonucleotides may be modified such as by 2'-O-methyl or 2'-fluoro. Alternative approaches used methylphosphonate or phosphoramidate linkages in said arms. Further embodiments of the antisense oligonucleotide useful in the practice of the present invention are P-methoxyoligonucleotides, partial P-methoxyoligodeoxyribonucleotides or P-methoxyoligonucleotides.

Of particular relevance and usefulness for the present invention are those antisense oligonucleotides as more particularly described in the above two mentioned US patents. These oligonucleotides contain no naturally occurring 5'→3'-linked nucleotides. Rather the oligonucleotides have two types of nucleotides: 2'-deoxyphosphorothioate, which activate RNase H, and 2'-modified nucleotides, which do not. The linkages between the 2'-modified nucleotides can be phosphodiesters, phosphorothioate or P-ethoxyphosphodiester. Activation of RNase H is accomplished by a contiguous RNase H-activating region, which contains between 3 and 5 2'-deoxyphosphorothioate nucleotides to activate bacterial RNase H and between 5 and 10 2'-deoxyphosphorothioate nucleotides to activate eucaryotic and, particularly, mammalian RNase H. Protection from degradation is accomplished by making the 5' and 3' terminal bases highly nuclease resistant and, optionally, by placing a 3' terminal blocking group.

More particularly, the antisense oligonucleotide comprises a 5' terminus and a 3' terminus; and from position 11 to 59 5'→3'-linked nucleotides independently selected from the group consisting of 2'-modified phosphodiester nucleotides and 2'-modified P-alkyloxyphosphotriester nucleotides; and wherein the 5'-terminal nucleoside is attached to an RNase H-activating region of between three and ten contiguous phosphorothioate-linked deoxyribonucleotides, and wherein the 3'-terminus of said oligonucleotide is selected from the group consisting of an inverted deoxyribonucleotide, a contiguous stretch of one to three phosphorothioate 2'-modified ribonucleotides, a biotin group and a P-alkyloxyphosphotriester nucleotide.

Also an antisense oligonucleotide may be used wherein not the 5' terminal nucleoside is attached to an RNase H-activating region but the 3' terminal nucleoside as specified above. Also, the 5' terminus is selected from the particular group rather than the 3' terminus of said oligonucleotide.

The nucleic acids as well as the hyperimmune serum reactive antigens and fragments thereof according to the present invention may be used as or for the manufacture of pharmaceutical compositions, especially vaccines. Preferably such pharmaceutical composition, preferably vaccine is for the prevention or treatment of diseases caused by, related to or associated with E. faecalis. In so far another aspect of the invention relates to a method for inducing an immunological response in an individual, particularly a mammal, which comprises inoculating the individual with the hyperimmune serum reactive antigens and fragments thereof of the invention, or a fragment or variant thereof, adequate to produce antibodies to protect said individual from infection, particularly enterococcal infection and most particularly E. faecalis infections.

Yet another aspect of the invention relates to a method of inducing an immunological response in an individual which comprises, through gene therapy or otherwise, delivering a nucleic acid functionally encoding hyperimmune serum reactive antigens and fragments thereof, or a fragment or a variant thereof, for expressing the hyperimmune serum reactive antigens and fragments thereof, or a fragment or a variant thereof in vivo in order to induce an immunological response to produce antibodies or a cell mediated T cell response, either cytokine-producing T cells or cytotoxic T cells, to protect said individual from disease, whether that disease is already established within the individual or not. One way of administering the gene is by accelerating it into the desired cells as a coating on particles or otherwise.

A further aspect of the invention relates to an immunological composition which, when introduced into a host capable of having induced within it an immunological response, induces an immunological response in such host, wherein the composition comprises recombinant DNA which codes for and expresses an antigen of the hyperimmune serum reactive antigens and fragments thereof of the present invention. The immunological response may be used therapeutically or prophylactically and may take the form of antibody immunity or cellular immunity such as that arising from CTL or CD4+ T cells.

The hyperimmune serum reactive antigens and fragments thereof of the invention or a fragment thereof may be fused with a co-protein which may not by itself produce antibodies, but is capable of stabilizing the first protein and producing a fused protein which will have immunogenic and protective properties. This fused recombinant protein preferably further comprises an antigenic co-protein, such as Glutathione-S-transferase (GST) or beta-galactosidase, relatively large co-proteins which solubilise the protein and facilitate production and purification thereof. Moreover, the co-protein may act as an adjuvant in the sense of providing a generalized stimulation of the immune system. The co-protein may be attached to either the amino or carboxy terminus of the first protein.

Also, provided by this invention are methods using the described nucleic acid molecule or particular fragments thereof in such genetic immunization experiments in animal models of infection with E. faecalis. Such fragments will be particularly useful for identifying protein epitopes able to provoke a prophylactic or therapeutic immune response. This approach can allow for the subsequent preparation of monoclonal antibodies of particular value from the requisite organ of the animal successfully resisting or clearing infection for the development of prophylactic agents or therapeutic treatments of enterococcal infection in mammals, particularly humans.

The hyperimmune serum reactive antigens and fragments thereof may be used as an antigen for vaccination of a host to produce specific antibodies which protect against invasion of bacteria, for example by blocking adherence of bacteria to damaged tissue. Examples of tissue damage include wounds in skin or connective tissue caused e.g. by mechanical, chemical or thermal damage or by implantation of indwelling devices, or wounds in the mucous membranes, such as the mouth, mammary glands, urethra or vagina.

The present invention also includes a vaccine formulation which comprises the immunogenic recombinant protein together with a suitable carrier. Since the protein may be broken down in the stomach, it is preferably administered parenterally, including, for example, administration that is subcutaneous, intramuscular, intravenous, intradermal intranasal or transdermal. Formulations suitable for parenteral administration include aqueous and non-aqueous sterile injection solutions which may contain anti-oxidants, buffers, bacteriostats and solutes which render the formulation isotonic with the bodily fluid, preferably the blood, of the individual; and aqueous and non-aqueous sterile suspensions which may include suspending agents or thickening agents. The formulations may be presented in unit-dose or multi-dose containers, for example, sealed ampoules and vials, and may be stored in a freeze-dried condition requiring only the addition of the sterile liquid carrier immediately prior to use. The vaccine formulation may also include adjuvant systems for enhancing the immunogenicity of the formulation, such as oil-in-water systems and other systems known in the art. The dosage will depend on the specific activity of the vaccine and can be readily determined by routine experimentation.

According to another aspect, the present invention relates to a pharmaceutical composition comprising such a hyperimmune serum-reactive antigen or a fragment thereof as provided in the present invention for E. faecalis. Such a pharmaceutical composition may comprise one, preferably at least two, or more hyperimmune serum reactive antigens or fragments thereof against E. faecalis. Optionally, such E. faecalis hyperimmune serum reactive antigens or fragments thereof may also be combined with antigens against other pathogens in a combination pharmaceutical composition. Preferably, said pharmaceutical composition is a vaccine for preventing or treating an infection caused by E. faecalis and/or other pathogens against which the antigens have been included in the vaccine.

According to a further aspect, the present invention relates to a pharmaceutical composition comprising a nucleic acid molecule encoding a hyperimmune serum-reactive antigen or a fragment thereof as identified above for E. faecalis. Such a pharmaceutical composition may comprise one or more nucleic acid molecules encoding hyperimmune serum reactive antigens or fragments thereof against E. faecalis. Optionally, such E. faecalis nucleic acid molecules encoding hyperimmune serum reactive antigens or fragments thereof may also be combined with nucleic acid molecules encoding antigens against other pathogens in a combination pharmaceutical composition. Preferably, said pharmaceutical composition is a vaccine for preventing or treating an infection caused by E. faecalis and/or other pathogens against which the antigens have been included in the vaccine.

The pharmaceutical composition may contain any suitable auxiliary substances, such as buffer substances, stabilisers or further active ingredients, especially ingredients known in connection of pharmaceutical composition and/or vaccine production.

A preferable carrier/or excipient for the hyperimmune serum-reactive antigens, fragments thereof or a coding nucleic acid molecule thereof according to the present invention is an immunostimulatory compound for further stimulating the immune response to the given hyperimmune serum-reactive antigen, fragment thereof or a coding nucleic acid molecule thereof. Preferably the immunostimulatory compound in the pharmaceutical preparation according to the present invention is selected from the group of polycationic substances, especially polycationic peptides, immunostimulatory nucleic acids molecules, preferably immunostimulatory deoxynucleotides, alum, Freund's complete adjuvants, Freund's incomplete adjuvants, neuroactive compounds, especially human growth hormone, or combinations thereof.

It is also within the scope of the present invention that the pharmaceutical composition, especially vaccine, comprises apart from the hyperimmune serum reactive antigens, fragments thereof and/or coding nucleic acid molecules thereof according to the present invention other compounds which are biologically or pharmaceutically active. Preferably, the vaccine composition comprises at least one polycationic peptide. The polycationic compound(s) to be used according to the present invention may be any polycationic compound which shows the characteristic effects according to the WO 97/30721. Preferred polycationic compounds are selected from basic polypeptides, organic polycations, basic polyamino acids or mixtures thereof. These polyamino acids should have a chain length of at least 4 amino acid residues (WO 97/30721). Especially preferred are substances like polylysine, polyarginine and polypeptides containing more than 20%, especially more than 50% of basic amino acids in a range of more than 8, especially more than 20, amino acid residues or mixtures thereof. Other preferred polycations and their pharmaceutical compositions are described in WO 97/30721 (e.g. polyethyleneimine) and WO 99/38528. Preferably these polypeptides contain between 20 and 500 amino acid residues, especially between 30 and 200 residues.

These polycationic compounds may be produced chemically or recombinantly or may be derived from natural sources.

Cationic (poly)peptides may also be anti-microbial with properties as reviewed in {Ganz, T., 1999}. These (poly) peptides may be of prokaryotic or animal or plant origin or may be produced chemically or recombinantly (WO 02/13857). Peptides may also belong to the class of defensins (WO 02/13857). Sequences of such peptides can be, for example, found in the Antimicrobial Sequences Database (University of Trieste, Italy)

Such host defence peptides or defensives are also a preferred form of the polycationic polymer according to the present invention. Generally, a compound allowing as an end product activation (or down-regulation) of the adaptive immune system, preferably mediated by APCs (including dendritic cells) is used as polycationic polymer.

Especially preferred for use as polycationic substances in the present invention are cathelicidin derived antimicrobial peptides or derivatives thereof (International patent application WO 02/13857, incorporated herein by reference), especially antimicrobial peptides derived from mammalian cathelicidin, preferably from human, bovine or mouse.

Polycationic compounds derived from natural sources include HIV-REV or HIV-TAT (derived cationic peptides, antennapedia peptides, chitosan or other derivatives of chitin) or other peptides derived from these peptides or proteins by biochemical or recombinant production. Other preferred polycationic compounds are cathelin or related or derived substances from cathelin. For example, mouse cathelin is a peptide which has the amino acid sequence $NH_2$-RLAGLL-RKGGEKIGEKLKKIGOKIKNFFQKLVPQPE-COOH (SEQ ID NO:480). Related or derived cathelin substances contain the whole or parts of the cathelin sequence with at least 15-20 amino acid residues. Derivations may include the substitution or modification of the natural amino acids by amino acids which are not among the 20 standard amino acids. Moreover, further cationic residues may be introduced into such cathelin molecules. These cathelin molecules are preferred to be combined with the antigen. These cathelin molecules surprisingly have turned out to be also effective as an adjuvant for an antigen without the addition of further adjuvants. It is therefore possible to use such cathelin molecules as efficient adjuvants in vaccine formulations with or without further immunactivating substances.

Another preferred polycationic substance to be used according to the present invention is a synthetic peptide containing at least 2 KLK-motifs separated by a linker of 3 to 7 hydrophobic amino acids (International patent application WO 02/32451, incorporated herein by reference).

The pharmaceutical composition of the present invention may further comprise immunostimulatory nucleic acid(s). Immunostimulatory nucleic acids are e.g. neutral or artificial CpG containing nucleic acids, short stretches of nucleic acids derived from non-vertebrates or in form of short oligonucleotides (ODNs) containing non-methylated cytosine-guanine di-nucleotides (CpG) in a certain base context (e.g. described in WO 96/02555). Alternatively, also nucleic acids based on inosine and cytidine as e.g. described in the WO 01/93903, or deoxynucleic acids containing deoxy-inosine and/or deoxyuridine residues (described in WO 01/93905 and PCT/EP 02/05448, incorporated herein by reference) may preferably be used as immunostimulatory nucleic acids for the present invention. Preferably, the mixtures of different immunostimulatory nucleic acids may be used according to the present invention.

It is also within the present invention that any of the aforementioned polycationic compounds is combined with any of the immunostimulatory nucleic acids as aforementioned. Preferably, such combinations are according to the ones as described in WO 01/93905, WO 02/32451, WO 01/54720, WO 01/93903, WO 02/13857 and PCT/EP 02/05448 and the Austrian patent application A 1924/2001, incorporated herein by reference.

In addition or alternatively such vaccine composition may comprise apart from the hyperimmune serum reactive antigens and fragments thereof, and the coding nucleic acid molecules thereof according to the present invention a neuroactive compound. Preferably, the neuroactive compound is human growth factor as, e.g. described in WO 01/24822. Also preferably, the neuroactive compound is combined with any of the polycationic compounds and/or immunostimulatory nucleic acids as afore-mentioned.

In a further aspect the present invention is related to a pharmaceutical composition. Such pharmaceutical composition is, for example, the vaccine described herein. Also a pharmaceutical composition is a pharmaceutical composition which comprises any of the following compounds or combinations thereof: the nucleic acid molecules according to the present invention, the hyperimmune serum reactive antigens and fragments thereof according to the present invention, the vector according to the present invention, the cells according to the present invention, the antibody according to the present invention, the functional nucleic acids according to the present invention and the binding peptides such as the anticalines according to the present invention, any agonists and antagonists screened as described herein. In connection therewith any of these compounds may be employed in combination with a non-sterile or sterile carrier or carriers for use with cells, tissues or organisms, such as a pharmaceutical carrier suitable for administration to a subject. Such compositions comprise, for instance, a media additive or a therapeutically effective amount of a hyperimmune serum reactive antigen and fragments thereof of the invention and a pharmaceutically acceptable carrier or excipient. Such carriers may include, but are not limited to, saline, buffered saline, dextrose, water, glycerol, ethanol and combinations thereof. The formulation should suit the mode of administration.

The pharmaceutical compositions may be administered in any effective, convenient manner including, for instance, administration by topical, oral, anal, vaginal, intravenous, intraperitoneal, intramuscular, subcutaneous, intranasal or intradermal routes among others.

In therapy or as a prophylactic, the active agent may be administered to an individual as an injectable composition, for example as a sterile aqueous dispersion, preferably isotonic.

Alternatively the composition may be formulated for topical application, for example in the form of ointments, creams, lotions, eye ointments, eye drops, ear drops, mouthwash, impregnated dressings and sutures and aerosols, and may contain appropriate conventional additives, including, for example, preservatives, solvents to assist drug penetration, and emollients in ointments and creams. Such topical formulations may also contain compatible conventional carriers, for example cream or ointment bases, and ethanol or oleyl alcohol for lotions. Such carriers may constitute from about 1% to about 98% by weight of the formulation; more usually they will constitute up to about 80% by weight of the formulation.

In addition to the therapy described above, the compositions of this invention may be used generally as a wound treatment agent to prevent adhesion of bacteria to matrix proteins exposed in wound tissue and for prophylactic use in dental treatment as an alternative to, or in conjunction with, antibiotic prophylaxis.

A vaccine composition is conveniently in injectable form. Conventional adjuvants may be employed to enhance the immune response. A suitable unit dose for vaccination is 0.05-5 µg antigen/per kg of body weight, and such dose is preferably administered 1-3 times and with an interval of 1-3 weeks.

With the indicated dose range, no adverse toxicological effects should be observed with the compounds of the invention which would preclude their administration to suitable individuals.

In a further embodiment the present invention relates to diagnostic and pharmaceutical packs and kits comprising one or more containers filled with one or more of the ingredients of the aforementioned compositions of the invention. The ingredient(s) can be present in a useful amount, dosage, formulation or combination. Associated with such container(s) can be a notice in the form prescribed by a governmental agency regulating the manufacture, use or sale of pharmaceuticals or biological products, reflecting approval by the agency of the manufacture, use or sale of the product for human administration.

In connection with the present invention any disease related use as disclosed herein such as, e.g. use of the pharmaceutical composition or vaccine, is particularly a disease or diseased condition which is caused by, linked or associated with Enterococci, more preferably, *E. faecalis*. In connection therewith it is to be noted that *E. faecalis* comprises several strains including those disclosed herein. A disease related, caused or associated with the bacterial infection to be prevented and/or treated according to the present invention includes besides others bacterial pharyngitis, scarlet fever, impetigo, rheumatic fever, necrotizing fascitis and sepsis in humans.

In a still further embodiment the present invention is related to a screening method using any of the hyperimmune serum reactive antigens or nucleic acids according to the present invention. Screening methods as such are known to the one skilled in the art and can be designed such that an agonist or an antagonist is screened. Preferably an antagonist is screened which in the present case inhibits or prevents the binding of any hyperimmune serum reactive antigen and fragment thereof according to the present invention to an interaction partner. Such interaction partner can be a naturally occurring interaction partner or a non-naturally occurring interaction partner.

The invention also provides a method of screening compounds to identify those which enhance (agonist) or block (antagonist) the function of hyperimmune serum reactive antigens and fragments thereof or nucleic acid molecules of the present invention, such as its interaction with a binding molecule. The method of screening may involve high-throughput.

For example, to screen for agonists or antagonists, the interaction partner of the nucleic acid molecule and nucleic acid, respectively, according to the present invention, maybe a synthetic reaction mix, a cellular compartment, such as a membrane, cell envelope or cell wall, or a preparation of any thereof, may be prepared from a cell that expresses a molecule that binds to the hyperimmune serum reactive antigens and fragments thereof of the present invention. The preparation is incubated with labelled hyperimmune serum reactive antigens and fragments thereof in the absence or the presence of a candidate molecule which may be an agonist or antagonist. The ability of the candidate molecule to bind the binding molecule is reflected in decreased binding of the labelled ligand. Molecules which bind gratuitously, i.e., without inducing the functional effects of the hyperimmune serum reactive antigens and fragments thereof, are most likely to be good antagonists. Molecules that bind well and elicit functional effects that are the same as or closely related to the hyperimmune serum reactive antigens and fragments thereof are good agonists.

The functional effects of potential agonists and antagonists may be measured, for instance, by determining the activity of a reporter system following interaction of the candidate molecule with a cell or appropriate cell preparation, and comparing the effect with that of the hyperimmune serum reactive antigens and fragments thereof of the present invention or molecules that elicit the same effects as the hyperimmune serum reactive antigens and fragments thereof. Reporter systems that may be useful in this regard include but are not limited to colorimetric labelled substrate converted into product, a reporter gene that is responsive to changes in the functional activity of the hyperimmune serum reactive antigens and fragments thereof, and binding assays known in the art.

Another example of an assay for antagonists is a competitive assay that combines the hyperimmune serum reactive antigens and fragments thereof of the present invention and a potential antagonist with membrane-bound binding molecules, recombinant binding molecules, natural substrates or ligands, or substrate or ligand mimetics, under appropriate conditions for a competitive inhibition assay. The hyperimmune serum reactive antigens and fragments thereof can be labelled such as by radioactivity or a colorimetric compound, such that the molecule number of hyperimmune serum reactive antigens and fragments thereof bound to a binding molecule or converted to product can be determined accurately to assess the effectiveness of the potential antagonist.

Potential antagonists include small organic molecules, peptides, polypeptides and antibodies that bind to a hyperimmune serum reactive antigen and fragments thereof of the invention and thereby inhibit or extinguish its activity. Potential antagonists also may be small organic molecules, a peptide, a polypeptide such as a closely related protein or antibody that binds to the same sites on a binding molecule without inducing functional activity of the hyperimmune serum reactive antigens and fragments thereof of the invention.

Potential antagonists include a small molecule which binds to and occupies the binding site of the hyperimmune serum reactive antigens and fragments thereof thereby preventing binding to cellular binding molecules, such that normal biological activity is prevented. Examples of small molecules include but are not limited to small organic molecules, peptides or peptide-like molecules.

Other potential antagonists include antisense molecules (see {Okano, H. et al., 1991}; OLIGODEOXYNUCLEOTIDES AS ANTISENSE INHIBITORS OF GENE EXPRESSION; CRC Press, Boca Ration, Fla. (1988), for a description of these molecules).

Preferred potential antagonists include derivatives of the hyperimmune serum reactive antigens and fragments thereof of the invention.

As used herein the activity of a hyperimmune serum reactive antigen and fragment thereof according to the present invention is its capability to bind to any of its interaction partner or the extent of such capability to bind to its or any interaction partner.

In a particular aspect, the invention provides the use of the hyperimmune serum reactive antigens and fragments thereof, nucleic acid molecules or inhibitors of the invention to interfere with the initial physical interaction between a pathogen and mammalian host responsible for sequelae of infection. In particular the molecules of the invention may be used: i) in the prevention of adhesion of E. faecalis to mammalian extracellular matrix proteins on in-dwelling devices or to extracellular matrix proteins in wounds; ii) to block protein mediated mammalian cell invasion by, for example, initiating phosphorylation of mammalian tyrosine kinases {Rosenshine, I. et al., 1992} to block bacterial adhesion between mammalian extracellular matrix proteins and bacterial proteins which mediate tissue damage; iv) to block the normal progression of pathogenesis in infections initiated other than by the implantation of in-dwelling devices or by other surgical techniques.

Each of the DNA coding sequences provided herein may be used in the discovery and development of antibacterial compounds. The encoded protein upon expression can be used as a target for the screening of antibacterial drugs. Additionally, the DNA sequences encoding the amino terminal regions of the encoded protein or Shine-Delgarno or other translation facilitating sequences of the respective mRNA can be used to construct antisense sequences to control the expression of the coding sequence of interest.

The antagonists and agonists may be employed, for instance, to inhibit diseases arising from infection with Enterococci, especially E. faecalis, such as sepsis.

In a still further aspect the present invention is related to an affinity device such affinity device comprises as least a support material and any of the hyperimmune serum reactive antigens and fragments thereof according to the present invention, which is attached to the support material. Because of the specificity of the hyperimmune serum reactive antigens and fragments thereof according to the present invention for their target cells or target molecules or their interaction partners, the hyperimmune serum reactive antigens and fragments thereof allow a selective removal of their interaction partner(s) from any kind of sample applied to the support material provided that the conditions for binding are met. The sample may be a biological or medical sample, including but not limited to, fermentation broth, cell debris, cell preparation, tissue preparation, organ preparation, blood, urine, lymph liquid, liquor and the like.

The hyperimmune serum reactive antigens and fragments thereof may be attached to the matrix in a covalent or non-covalent manner. Suitable support material is known to the one skilled in the art and can be selected from the group comprising cellulose, silicon, glass, aluminium, paramagnetic beads, starch and dextrane.

The present invention is further illustrated by the following figures, examples and the sequence listing from which further features, embodiments and advantages may be taken. It is to be understood that the present examples are given by way of illustration only and not by way of limitation of the disclosure.

In connection with the present invention

Table 1 shows the summary of all screens performed with genomic E. faecalis libraries and human serum and E. faecium proteins identified by homology search.

Table 2 shows the epitope serology with human sera.

The figures to which it might be referred to in the specification are described in the following in more details.

Figure 1:
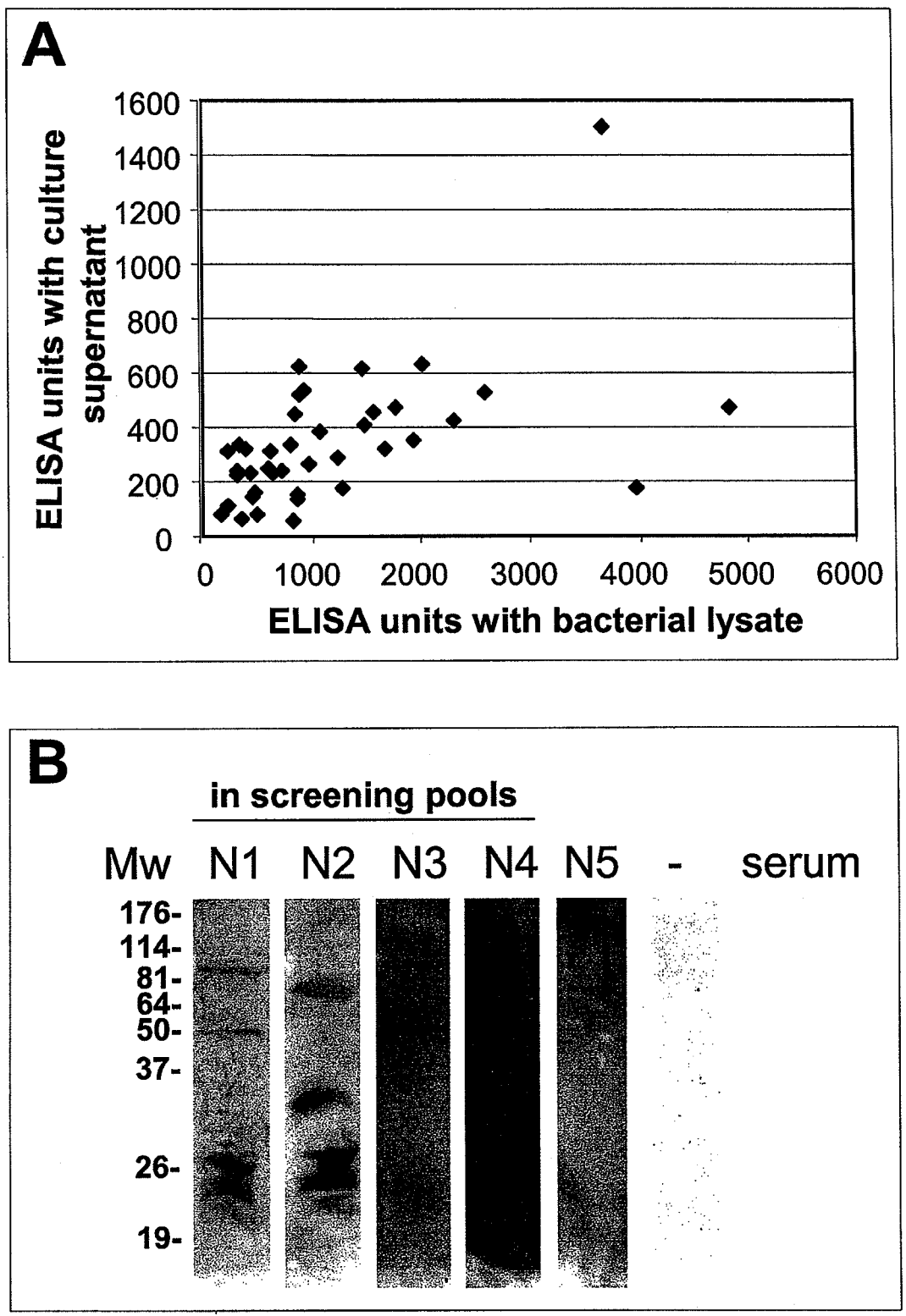
FIG. 1 shows the characterization of E. faecalis specific human sera.
Figure 1:
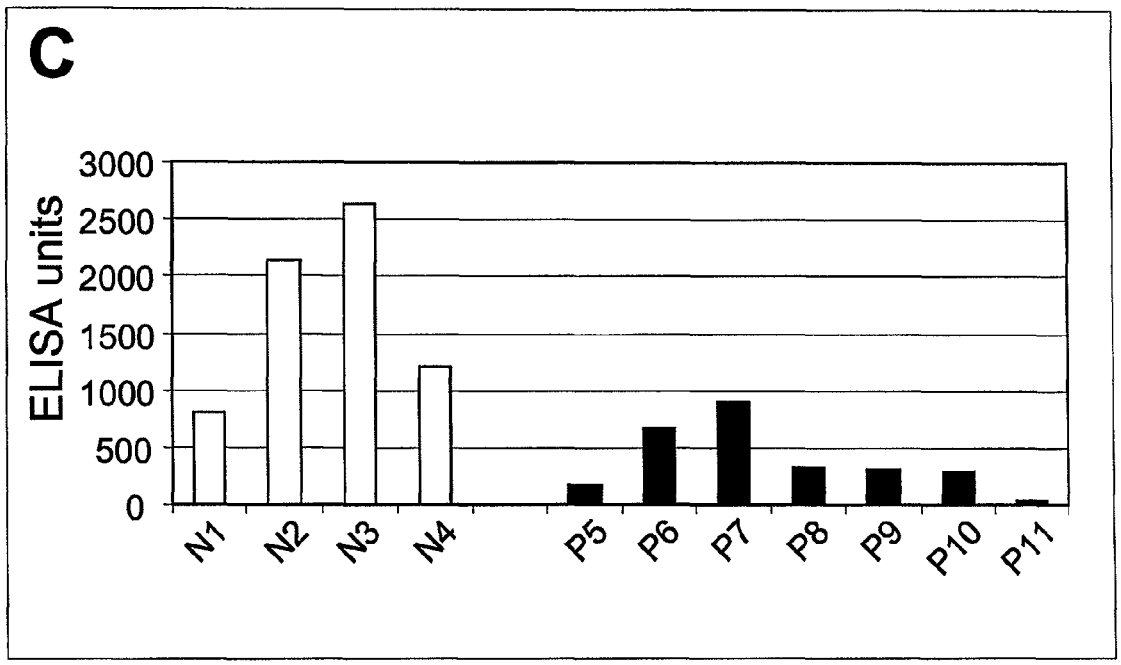
Figure 1:
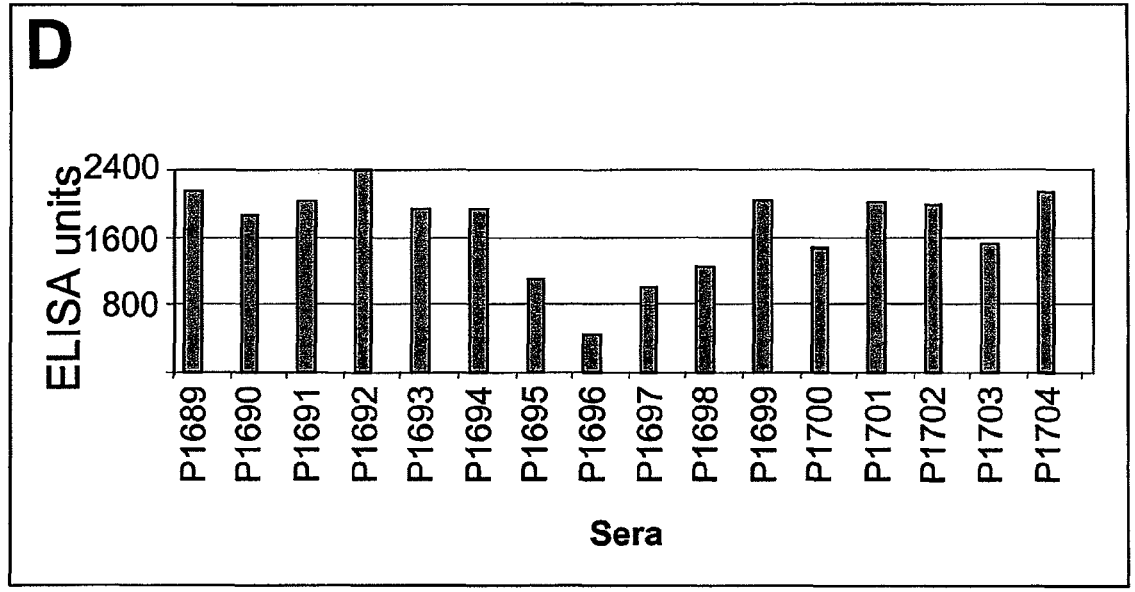
Figure 1:
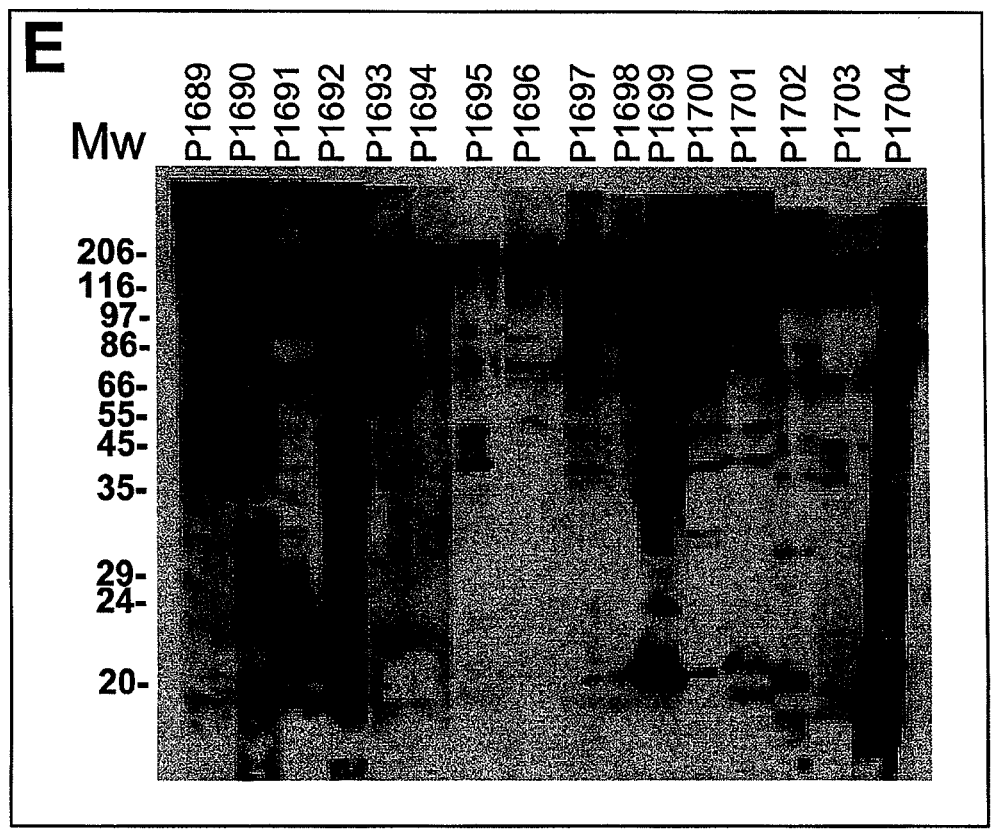

FIG. 1 shows the characterization of human sera for anti-E. faecalis antibodies as measured by immune assays. Total anti-E. faecalis IgG antibody levels were measured by standard ELISA using total bacterial lysates or culture supernant fractions prepared from E. faecalis strain V583 as coating antigens. (A) Results of representative experiments are shown with healthy adult sera. Data are expressed as ELISA units calculated from absorbance at 405 nm at two serum dilutions in the linear range of detection (2.000× and 10,000×). (B) Immunoblot analysis was performed with high titer sera from healthy adults selected by ELISA in order to ensure multiple immune reactivity with protein antigens. Results of a representative experiment using total bacterial lysate and selected human sera at 5.000× dilution are shown. Blots were developed with anti-human IgG secondary antibody reagent. Lanes 1-4: individual high titer sera included in screening pools (N1-4), lane 5: low titer serum (N5), lane 6: negative control, (no serum, 2nd antibody only). Mw: molecular weight markers. (C) shows the comparison of IgG titers obtained with sera from healthy adults (N, numbering is the same as for (B)) vs. acute phase patients (P) with enterococcal infections (such as wound infection, bacteremia, infected catheter). Data are expressed as ELISA units, and were calculated as for (A). (D) shows the results of experiments with convalescent sera from endocarditis patients. Data are expressed as ELISA units calculated from absorbance at 405 nm at serum dilution in the linear range of detection (2.000×). (E) Immunoblot analysis was performed with high titer sera from endocarditis patients in order to ensure multiple immune reactivity with protein antigens. Results of a representative experiment using total bacterial lysate and selected human sera at 5.000× dilution are shown. Blots were developed with anti-human IgG secondary antibody reagent. Lanes 1-16: individual sera from endocarditis patients. Mw: molecular weight markers.

Figure 2:
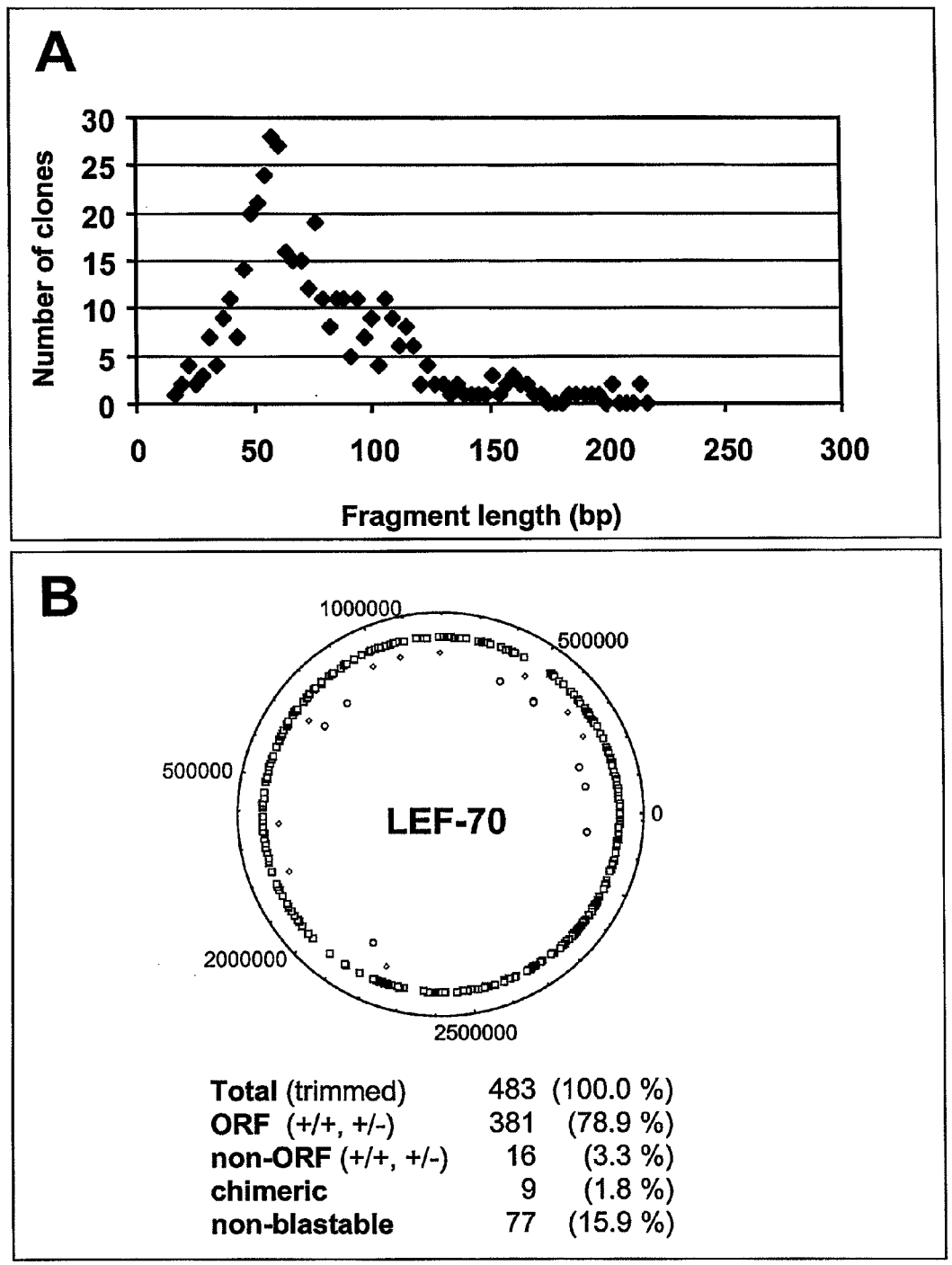
FIG. 2 shows the characterization of the small fragment genomic library, LEF-70, from Enterococcus faecalis V583.

FIG. 2 (A) shows the fragment size distribution of the *Enterococcus faecalis* V583 small fragment genomic library, LEF-70. After sequencing 576 randomly selected clones, sequences were trimmed to eliminate vector residues and the numbers of clones with various genomic fragment sizes were plotted. (B) shows the graphic illustration of the distribution of the set of 483 randomly sequenced clones of LEF-70 over the *Enterococcus faecalis* V583 chromosome. Rectangles indicate matching sequences to annotated ORFs and diamonds represent fully matched clones to non-coding chromosomal sequences in +/+ or +/− orientation, respectively. Circles position all clones with chimeric sequences. Numeric distances in base pairs are indicated over the circular genome for orientation. Partitioning of various clone sets within the library is given in numbers and percentage at the bottom of the figure.

Figure 3:
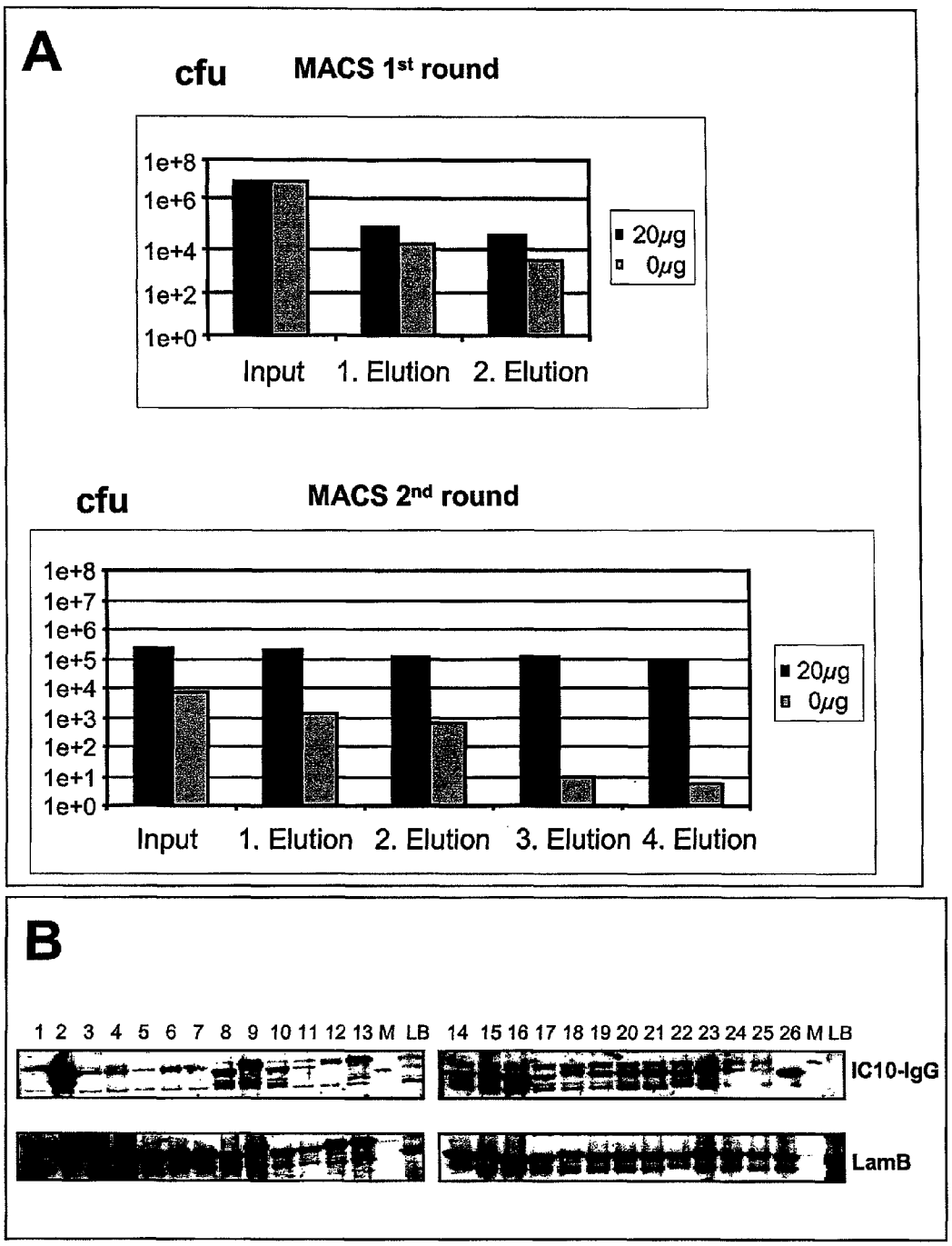
FIG. 3 shows the selection of bacterial cells by MACS using biotinylated human IgGs.

FIG. 3A shows the MACS selection with biotinylated human IgGs. The LEF-70 library in pMAL9.1 was screened with 20 µg biotinylated, human serum (IC10-IgG) in the first and in the second selection round. As negative control, no serum was added to the library cells for screening. Number of cells selected after the $1^{st}$ and $2^{nd}$ elution for round 1 and $1^{st}$ to $4^{th}$ elution for round 2 are shown for the selection with and without added IgGs. FIG. 3B shows the reactivity of specific clones (1-26) isolated after 2 rounds of bacterial surface display as analysed by Western blot analysis with the human serum (IC10-IgG, approximately 4 µg/µl) used for selection by MACS at a dilution of 1:3,000. As a loading control the same blot was also analysed with antibodies directed against the platform protein LamB at a dilution of 1:5,000. LB, Extract from a clone expressing LamB without foreign peptide insert.

Table 1: Immunogenic Proteins Identified by Bacterial Surface Display.

1a shows the antigens identified with sera from healthy adults with high anti-enterococcus titer. A, LEF-300 library from *Enterococcus faecalis* V583 in fhuA with IC10-IgG (723), B, LEF-300 library in fhuA with IC9-IgG (389), C, LEF-70 library in lamB with IC10-IgG (1096), D, LEF-70 library in lamB with IC9-IgG (1065). Table 1b shows *E. faecium* proteins identified by homology search with a minimum of 70% identity to *E. faecalis* antigens listed in table 1a. The computer program TBLASTN was used to determine identity between *E. faecalis* and *E. faecium* sequences. The amino acid sequence identity was calculated based on the complete ORF sequence of the corresponding *E. faecalis* antigen. 1c shows the antigens identified with sera from convalescing endocarditis patients with high anti-enterococcus titer. E, LEF-70 library from *Enterococcus faecalis* V583 in LamB with P25-IgG (843); F, LEF-70 library in LamB with P26-IgG (845); G, LEF-300 library in FhuA with P25-IgG (691); H, LEF-300 library in FhuA with P26-IgG (770); *, prediction of antigenic sequences longer than 5 amino acids was performed with the program ANTIGENIC {Kolaskar, A. et al., 1990}.

Table 2: Epitope Serology with Human Sera.

Immune reactivity of individual synthetic peptides representing selected epitopes with individual human sera is shown. Extent of reactivity is colour coded; white: − (<100 U), light grey: + (100-249 U), dark grey: ++ (250-349 U), black: +++ (>350 U). ELISA units (U) are calculated from $OD_{405nm}$ readings and the serum dilution. Score is calculated as the sum of all reactivities (−=0; +=1; ++=2; +++=3). N1 to N10 sera are high titer sera from healthy adults used in the screens with IC9- and IC10 IgG pools. P1-P11 are sera from patients with *E. faecalis* infections. Location of synthetic peptides within the antigenic ORFs according to the genome annotation of V583 strain are given indicating the first and last amino acid residues. Peptide names: EF0020.1 present in annotated ORF EF0020 on the chromosome; ARF0679.1, potential novel ORF in alternative reading-frame of EF0679; EFC0034.1 present in annotated ORF from plasmid C; ARFC0021.1 present in potential novel ORF in alternative reading-frame of ARFC0021 from plasmid C.

EXAMPLES

Example 1

Characterization and Selection of Human Serum Sources Based on Anti-*E. faecalis* Antibodies, Preparation of Antibody Screening Reagents Experimental Procedures
Enzyme Linked Immune Assay (ELISA).
ELISA plates (Maxisorb, Millipore) were coated with 5-10 µg/ml total protein diluted in coating buffer (0.1M sodium carbonate pH 9.2). Three dilutions of sera (2,000×, 10,000×, 50,000×) were made in PBS-BSA. Highly specific Horse Radish Peroxidase (HRP)-conjugated anti-human IgG or anti-human IgA secondary antibodies (Southern Biotech) were used according to the manufacturers' recommendations (dilution: 1,000×). Antigen-antibody complexes were quantified by measuring the conversion of the substrate (ABTS) to colored product based on $OD_{405nm}$ readings by automatic ELISA reader (TECAN SUNRISE).

Preparation of Bacterial Antigen Extracts
Total bacterial lysate: Bacteria were grown overnight in BHI (Brain-heart Infusion) and lysed by repeated freeze-thaw cycles: incubation on dry ice/ethanol-mixture until frozen (1 min), then thawed at 37° C. (5 min): repeated 3 times. This was followed by sonication and collection of supernatant by centrifugation (3,500 rpm, 15 min, 4° C.).

Culture supernatant: After removal of bacteria by centrifugation, the supernatant of overnight grown bacterial cultures was precipitated with ice-cold ethanol by mixing 1 part supernatant with 3 parts absolute ethanol and incubated overnight at −20° C. Precipitates were collected by centrifugation (2,600 g, for 15 min). Dry pellets were dissolved either in PBS for ELISA, or in urea and SDS-sample buffer for SDS-PAGE and immunoblotting. The protein concentration of samples was determined by Bradford assay.

Immunoblotting
Total bacterial lysate and culture supernatant samples were prepared from in vitro grown *E. faecalis* strain V583. 10 to 25 µg total protein/lane was separated by SDS-PAGE using the BioRad Mini-Protean Cell electrophoresis system and proteins transferred to nitrocellulose membrane (ECL, Amersham Pharmacia). After overnight blocking in 5% milk, human sera were added at 2,000× dilution, and HRPO labeled anti-human IgG was used for detection.

Purification of Antibodies for Genomic Screening.
Five sera from both the patient and the healthy group were selected based on the overall anti-*E. faecalis* titers for serum pools used in the screening procedure. Antibodies against *E. coli* proteins were removed by incubating the heat-inactivated sera with whole cell *E. coli* cells (DH5alpha, transformed with pHIE11, grown under the same condition as used for bacterial surface display). Highly enriched preparations of IgGs from the pooled, depleted sera were generated by protein G affinity chromatography, according to the manufacturer's instructions (UltraLink Immobilized Protein G, Pierce). The efficiency of depletion and purification was checked by SDS-PAGE, Western blotting, ELISA and protein concentration measurements.

Results

The antibodies produced against E. faecalis by the human immune system and present in human sera are indicative of the in vivo expression of the antigenic proteins and their immunogenicity. These molecules are essential for the identification of individual antigens in the approach as described in the present invention, which is based on the interaction of the specific anti-enterococcal antibodies and the corresponding Enterococcal peptides or proteins. To gain access to relevant antibody repertoires, human sera were collected from healthy adults, as well from patients with enterococcal infections and naïve individuals, young children between 5 and 10 months of age, after they already lost maternal antibodies.

Antibodies in serum and other body fluids, induced in individuals exposed to the pathogens are crucial for antigen identification. The exposure to Enterococci results in asymptomatic colonization, current or past acute or chronic infection. E. faecalis colonization and infections are common, and antibodies are present as a consequence of natural immunization from previous encounters. Since Enterococci are opportunistic (not obligate) pathogens, it is likely that sera from healthy individuals also contain relevant antibodies.

70 sera from healthy adults, 16 from patients convalescing from endocarditis caused by E. faecalis and 8 from patients with acute infection (mainly wound and bacteremia) were characterized for anti-E. faecalis antibodies by a series of immune assays. Primary characterization was done by ELISA using two different antigen preparations, such as total bacterial extract and culture supernatant proteins prepared from E. faecalis V583 strain. Representative experiments are shown in FIG. 1 using sera from the healthy adult population (FIG. 1A) and from endocarditis patients (FIG. 1D). Antibody titers were compared at given dilutions where the response was linear. Sera were ranked based on the IgG reactivity against the two complex antigenic mixtures, and the highest ones were selected for further testing by immunoblotting. This analysis confirmed high antibody reactivity of the pre-selected sera against multiple Enterococcal proteins (FIGS. 1B&E), especially when compared to not selected, low-titer sera. ELISA ranking of sera did not always correlated with immunoblot signals suggesting that antibodies against non-protein components (e.g. lipoteichoic acid, peptidoglycan, etc.) contributed to the total ELISA reactivities against total bacterial extracts. Thus the final selection of sera to be included in antibody-pools was based mainly on multiple immunogenic bands in immunoblotting experiments. This extensive antibody characterization approach has led to the unambiguous identification of anti-E. faecalis hyperimmune sera. These selected sera from healthy adults were compared to sera from patients with various acute enterococcal infections, such as wound infection, bacteremia and catheter related infections. It was obvious that anti-E. faecalis antibody titer was lower in the acute patient group, suggesting that disease might occur in low titer individuals (FIG. 1C). These patient sera were then used mainly for validation purposes, that is measuring antibody levels against identified epitopes. However, patients with endocarditis caused by E. faecalis (verified by routine microbiological diagnosis) developed high levels of antibodies in the convalescent phase, as it is demonstrated by the high percentage of high titer sera among the 16 samples analysed here (FIGS. 1E&D).

10 sera were selected from the healthy adults and 10 from the convalescent patients with endocarditis donor groups. Sera were pooled (5 samples/pool), and IgG purified for antigen identification by bacterial surface display IgG antibodies were purified from pooled sera by affinity chromatography and depleted of E. coli-reactive antibodies to avoid background in the bacterial surface display screen (two IgG pools: NEf9, NEf10).

Example 2

Generation of Highly Random, Frame-Selected, Small-Fragment, Genomic DNA Libraries of Enterococcus faecalis Experimental Procedures Preparation of Enterococcal Genomic DNA.

50 ml Brain heart infusion (BHI) medium was inoculated with Enterococcus faecalis V583 bacteria from a frozen stab and grown with aeration and shaking for 18 h at 37° C. The culture was then harvested, centrifuged with 1,600×g for 15 min and the supernatant was removed. Bacterial pellets were washed 3× with PBS and carefully re-suspended in 0.5 ml of Lysozyme solution (100 mg/ml). 0.1 ml of 10 mg/ml heat treated RNase A and 20 U of RNase T1 were added, mixed carefully and the solution was incubated for 1 h at 37° C. Following the addition of 0.2 ml of 20% SDS solution and 0.1 ml of Proteinase K (10 mg/ml) the tube was incubated overnight at 55° C. ⅓ volume of saturated NaCl was then added and the solution was incubated for 20 min at 4° C. The extract was pelleted in a microfuge (13,000 rpm) and the supernatant transferred into a new tube. The solution was extracted with PhOH/CHCl$_3$/IAA (25:24:1) and with CHCl$_3$/IAA (24:1). DNA was precipitated at room temperature by adding 0.6× volume of Isopropanol, spooled from the solution with a sterile Pasteur pipette and transferred into tubes containing 80% ice-cold ethanol. DNA was recovered by centrifuging the precipitates with 10-12,000×g, then dried on air and dissolved in ddH$_2$O.

Preparation of Small Genomic DNA Fragments.

Genomic DNA Fragments were mechanically sheared into fragments ranging in size between 150 and 300 bp using a cup-horn sonicator (Bandelin Sonoplus UV 2200 sonicator equipped with a BB5 cup horn, 10 sec. pulses at 100% power output) or into fragments of size between 50 and 70 bp mild DNase I treatment (Novagen). It was observed that sonication yielded a much tighter fragment size distribution when breaking the DNA into fragments of the 150-300 bp size range. However, despite extensive exposure of the DNA to ultrasonic wave-induced hydromechanical shearing force, subsequent decrease in fragment size could not be efficiently and reproducibly achieved. Therefore, fragments of 50 to 70 bp in size were obtained by mild DNase I treatment using Novagen's shotgun cleavage kit. A 1:20 dilution of DNase I provided with the kit was prepared and the digestion was performed in the presence of MnCl$_2$ in a 60 μl volume at 20° C. for 5 min to ensure double-stranded cleavage by the enzyme. Reactions were stopped with 2 μl of 0.5 M EDTA and the fragmentation efficiency was evaluated on a 2% TAE-agarose gel. This treatment resulted in total fragmentation of genomic DNA into near 50-70 bp fragments. Fragments were then blunt-ended twice using T4 DNA Polymerase in the presence of 100 μM each of dNTPs to ensure efficient flushing of the ends. Fragments were used immediately in ligation reactions or frozen at −20° C. for subsequent use.

Description of the Vectors.

The vector pMAL4.31 was constructed on a pASK-IBA backbone {Skerra, A., 1994} with the beta-lactamase (bla) gene exchanged with the Kanamycin resistance gene. In addition the bla gene was cloned into the multiple cloning site. The sequence encoding mature beta-lactamase is preceded by the leader peptide sequence of ompA to allow efficient secretion across the cytoplasmic membrane. Furthermore a sequence encoding the first 12 amino acids (spacer sequence) of mature beta-lactamase follows the ompA leader peptide sequence to avoid fusion of sequences immediately after the leader peptidase cleavage site, since e.g. clusters of positive charged amino acids in this region would decrease or abolish translocation across the cytoplasmic membrane {Kajava, A. et al., 2000}. A SmaI restriction site serves for library insertion. An upstream FseI site and a downstream NotI site, which were used for recovery of the selected fragment, flank the SmaI site. The three restriction sites are inserted after the sequence encoding the 12 amino acid spacer sequence in such a way that the bla gene is transcribed in the −1 reading frame resulting in a stop codon 15 bp after the NotI site. A +1 bp insertion restores the bla ORF so that beta-lactamase protein is produced with a consequent gain of Ampicillin resistance.

The vector pMAL9.1 was constructed by cloning the lamB gene into the multiple cloning site of pEH1 {Hashemzadeh-Bonehi, L. et al., 1998}. Subsequently, a sequence was inserted in lamB after amino acid 154, containing the restriction sites FseI, SmaI and NotI. The reading frame for this insertion was constructed in such a way that transfer of frame-selected DNA fragments excised by digestion with FseI and NotI from plasmid pMAL4.31 yields a continuous reading frame of lamB and the respective insert.

The vector pHIE11 was constructed by cloning the fhuA gene into the multiple cloning site of pEH1. Thereafter, a sequence was inserted in fhuA after amino acid 405, containing the restriction site FseI, XbaI and NotI. The reading frame for this insertion was chosen in a way that transfer of frame-selected DNA fragments excised by digestion with FseI and NotI from plasmid pMAL4.31 yields a continuous reading frame of fhuA and the respective insert.

Cloning and Evaluation of the Library for Frame Selection.

Genomic *E. faecalis* DNA fragments were ligated into the SmaI site of the vector pMAL4.31. Recombinant DNA was electroporated into DH10B electrocompetent *E. coli* cells (GIBCO BRL) and transformants plated on LB-agar supplemented with Kanamycin (50 µg/ml) and Ampicillin (50 µg/ml). Plates were incubated over night at 37° C. and colonies collected for large scale DNA extraction. A representative plate was stored and saved for collecting colonies for colony PCR analysis and large-scale sequencing. A simple colony PCR assay was used to initially determine the rough fragment size distribution as well as insertion efficiency. From sequencing data the precise fragment size was evaluated, junction intactness at the insertion site as well as the frame selection accuracy (3n+1 rule).

Cloning and Evaluation of the Library for Bacterial Surface Display.

Genomic DNA fragments were excised from the pMAL4.31 vector, containing the *E. faecalis* library with the restriction enzymes FseI and NotI. The entire population of fragments was then transferred into plasmids pMAL9.1 (LamB) or pHIE11 (FhuA), which have been digested with FseI and NotI. Using these two restriction enzymes, which recognise an 8 bp GC rich sequence, the reading frame that was selected in the pMAL4.31 vector is maintained in each of the platform vectors. The plasmid library was then transformed into *E. coli* DH5alpha cells by electroporation. Cells were plated onto large LB-agar plates supplemented with 50 µg/ml Kanamycin and grown over night at 37° C. at a density yielding clearly visible single colonies. Cells were then scraped off the surface of these plates, washed with fresh LB medium and stored in aliquots for library screening at −80° C.

Results

Libraries for Frame Selection.

Three libraries (LEF-70 and LEF-300) were generated in the pMAL4.31 vector with sizes of approximately 70 and 300 bp, respectively. For both library, ligation and subsequent transformation of approximately 1 µg of pMAL4.31 plasmid DNA and 50 ng of fragmented genomic *E. faecalis* DNA yielded approximately $1.5 \times 10^5$ to $1 \times 10^6$ clones after frame selection. To assess the randomness of the libraries, 576 randomly chosen clones of LEF-70 were sequenced. Of these sequences 483 were successfully trimmed and subjected to further bioinformatic analysis. The results showed that of these clones only very few were present more than once. Furthermore, it was shown that 73% of the clones fell in the size range between 25 and 100 bp and on average the clones had a size of 82 bp (FIG. 2). Almost all sequences followed the 3n+1 rule, showing that all clones were properly frame selected.

Bacterial Surface Display Libraries.

The display of peptides on the surface of *E. coli* required the transfer of the inserts from the LSPy libraries from the frame selection vector pMAL4.31 to the display plasmids pMAL9.1 (LamB) or pHIE11 (FhuA). Genomic DNA fragments were excised by FseI and NotI restriction and ligation of 5 ng inserts with 0.1 µg plasmid DNA and subsequent transformation into DH5alpha cells resulted in $7 \times 10^5$ to $2 \times 10^6$ clones. The clones were scraped off the LB plates and frozen without further amplification. These cells served as libraries for the subsequent screening procedure.

Example 3

Identification of Highly Immunogenic Peptide Sequences from *E. faecalis* Using Bacterial Surface Displayed Genomic Libraries and Human Serum Experimental Procedures MACS Screening.

Approximately $2.5 \times 10^8$ cells from a given library were grown in 5 ml LB-medium supplemented with 50 µg/ml Kanamycin for 2 h at 37° C. Expression was induced by the addition of 1 mM IPTG for 30 min. Cells were washed twice with fresh LB medium and approximately $2 \times 10^7$ cells re-suspended in 100 µl LB medium and transferred to an Eppendorf tube.

20 µg of biotinylated, human IgGs purified from serum was added to the cells and the suspension incubated over night at 4° C. with gentle shaking 900 µl of LB medium was added, the suspension mixed and subsequently centrifuged for 10 min at 6,000 rpm at 4° C. Antibody reacting positive clones were captured with biotinylated anti-human-IgG secondary antibodies. Cells were washed once with 1 ml LB and then re-suspended in 100 µl LB medium. 10 µl of MACS microbeads coupled to streptavidin (Miltenyi Biotech, Germany) were added and the incubation continued for 20 min at 4° C. Thereafter 900 µl of LB medium was added and the MACS microbead cell suspension was loaded onto the equilibrated MS column (Miltenyi Biotech, Germany) which was fixed to the magnet. (The MS columns were equilibrated by washing once with 1 ml 70% EtOH and twice with 2 ml LB medium.)

The column was then washed three times with 3 ml LB medium. After removal of the magnet, cells were eluted by washing with 2 ml LB medium. After washing the column with 3 ml LB medium, the 2 ml eluate was loaded a second time on the same column and the washing and elution process repeated. In some cases the washing and elution process was performed up to four times to increase the specificity of the selection procedure, resulting in a final eluate of 2 ml.

A second round of screening was performed as follows. The cells from the final eluate were collected by centrifugation and re-suspended in 1 ml LB medium supplemented with 50 µg/ml Kanamycin. The culture was incubated at 37° C. for 90 min and then induced with 1 mM IPTG for 30 min. Cells were subsequently collected, washed once with 1 ml LB medium and suspended in 10 µl LB medium. For the second round of screening the same amount (20 µg) of human, biotinylated IgGs was added and the suspension incubated over night at 4° C. with gentle shaking. All further steps were exactly the same as in the first selection round, except that the number of washing, loading and elution cycles was adapted to each individual screening round. Cells selected after two rounds of selection were plated onto LB-agar plates supplemented with 50 µg/ml Kanamycin and grown over night at 37° C.

Evaluation of Selected Clones by Sequencing and Western Blot Analysis.

Selected clones were grown over night at 37° C. in 3 ml LB medium supplemented with 50 µg/ml Kanamycin to prepare plasmid DNA using standard procedures. Sequencing was performed at MWG (Germany) or in collaboration with TIGR (U.S.A.).

For Western blot analysis approximately 10 to 20 µg of total cellular protein was separated by 10% SDS-PAGE and blotted onto HybondC membrane (Amersham Pharmacia Biotech, England). The LamB or FhuA fusion proteins were detected using human serum as the primary antibody at a dilution of approximately 1:3,000 to 1:5,000 and anti-human IgG antibodies coupled to HRP at a dilution of 1:5,000 as secondary antibodies. Detection was performed using the ECL detection kit (Amersham Pharmacia Biotech, England). Alternatively, rabbit anti FhuA or mouse anti LamB antibodies were used as primary antibodies in combination with the respective secondary antibodies coupled to HRP for the detection of the fusion proteins.

Results

Screening of Bacterial Surface Display Libraries by Magnetic Activated Cell Sorting (MACS) using Biotinylated Igs.

The libraries LEF-70 in pMAL9.1 and LEF-300 in pHIE11 were screened with pools of biotinylated, human IgGs from sera from healthy individuals (Table 1a) or from sera from convalescent endocarditis patients (Table 1c) (see Example 1: Preparation of antibodies from human serum). The selection procedure was performed as described under Experimental procedures. FIG. 3A shows a representative example of a screen with the LEF-70 library and IC10-IgGs. As can be seen from the colony count after the first selection cycle from MACS screening, the total number of cells recovered at the end is drastically reduced from $1 \times 10^7$ cells to approximately $5 \times 10^4$ cells, whereas the selection without antibodies added showed a reduction to about $6 \times 10^3$ cells (FIG. 3A). For the second round, $2 \times 10^5$ cells were loaded on the column and almost all ($1 \times 10^5$) recovered with IC10-IgG after 4 cycles of loading, washing and elution, while fewer than 100 cells were recovered when no IgGs from human serum were added. This result clearly showed that selection was dependent on $E.$ $faecalis$ specific antibodies. Typically, the selection resulted in approximately 30 to 70% of clones to be selected specifically with the applied serum IgGs. For each screen between 400 and 1200 clones were subjected to DNA sequencing and the obtained sequence blasted against the genome of $Enterococcus$ $faecalis$ V583. This bioinformatic analysis allowed the evaluation of the screen on the basis of the frequency with which individual clones were selected by the addition of human IgGs. In order to confirm the good performance of the screen, all clones selected more than once were picked and subjected to Western blot analysis with the same, pooled serum IgGs (FIG. 3B). The analysis of the more frequently selected clones (>5x) revealed that more than 90% of these selected clones showed reactivity with antibodies present in the relevant serum whereas the control strain expressing LamB without a $E.$ $faecalis$ specific insert did not react with the same serum IgGs. In general, the clones which were selected with a lower frequency (<5x), showed a lower percentage of reactivity with the applied serum IgGs. Colony PCR analysis showed that all selected and tested clones contained an insert in the expected size range.

The sequencing of a large number of randomly picked clones (400 to 1200 per screen) led also to the identification of the gene and the corresponding peptide or protein sequence that was specifically recognized by the human serum IgGs used for screening. The frequency with which a specific clone is selected reflects at least in part the abundance and/or affinity of the specific antibodies in the serum used for selection and recognizing the epitope presented by this clone. In that regard it is striking that clones derived from some ORFs (e.g. EF3060, EFA0042) were picked multiple times and in more than one screen, indicating their highly immunogenic property. Table 1a summarizes the data obtained with four screens performed with sera from healthy adults and Table 1c with four screens with convalescent endocarditis patients sera. The latter table contains only the antigens that were novel relative to the ones listed in Table 1a. 26 antigens were identified by both sera, 71 and 42 unique antigenic ORFs were selected by the sera from healthy adults and patients, respectively.

All clones that are presented in Table 1 have been verified by Western blot analysis using whole cellular extracts from single clones to show the indicated reactivity with the pool of human serum used in the respective screen. As can be seen from Table 1, distinct regions of the identified ORF are identified as immunogenic, since variably sized fragments of the proteins are displayed on the surface by the platform proteins.

It is further worth noticing that many of the genes identified by the bacterial surface display screen encode proteins that are either attached to the surface of $E.$ $faecalis$ and/or are secreted. This is in accordance with the expected role of surface attached or secreted proteins in virulence of $E.$ $faecalis$.

Table 1b shows $E.$ $faecium$ proteins identified by homology search with a minimum of 70% identity to $E.$ $faecalis$ antigens listed in table 1a. The computer program TBLASTN was used to determine identity between $E.$ $faecalis$ and $E.$ $faecium$ sequences (http://www.hgsc.bcm.tmc.edu/microbial/microbialblast.cgi?organism=Efaecium). The amino acid sequence identity was calculated based on the complete ORF sequence of the corresponding $E.$ $faecalis$ antigen. This result demonstrated that $E.$ $faecium$ contains certain structurally related proteins to the clinically closely related species $E.$ $faecalis$. Since the homologous proteins in $E.$ $faecalis$ have been provided as hyperimmune serum reactive antigens in the present invention, the $E.$ $faecium$ proteins specified in Table 1b provide the same uses, especially the uses as antigens comprised in pharmaceutical composition e.g. vaccines against Enterococci infections.

Example 4

Assessment of the Reactivity of Highly Immunogenic Peptide Sequences with Individual Human Sera Experimental Procedures
Peptide Synthesis Peptides were synthesized in small scale (4 mg resin; up to 288 in parallel) using standard F-moc chemistry on a Rink amide resin (PepChem, Tübingen, Germany) using a SyroII synthesizer (Multisyntech, Witten, Germany). After the sequence was assembled, peptides were elongated with Fmoc-epsilon-aminohexanoic acid (as a linker) and biotin (Sigma, St. Louis, Mo.; activated like a normal amino acid). Peptides were cleaved off the resin with 93% TFA, 5% triethylsilane, and 2% water for one hour. Peptides were dried under vacuum and freeze dried three times from acetonitrile/water (1:1). The presence of the correct mass was verified by mass spectrometry on a Reflex III MALDI-TOF (Bruker, Bremen Germany). The peptides were used without further purification.

Enzyme Linked Immuno Assay (ELISA).

Biotin-labeled peptides (at the N-terminus) were coated on Streptavidin ELISA plates (EXICON) at 10 μg/ml concentration according to the manufacturer's instructions. Highly specific Horse Radish Peroxidase (HRP)-conjugated anti-human IgG secondary antibodies (Southern Biotech) were used according to the manufacturers' recommendations (dilution: 1,000×). Sera were tested at two serum dilutions, 200× and 1,000×. Following manual coating, peptide plates were processed and analyzed by the Gemini 160 ELISA robot (TECAN) with a built-in ELISA reader (GENIOS, TECAN).

Results

Following the bioinformatic analysis of selected clones, corresponding peptides were designed and synthesized. In case of epitopes with more than 26 amino acid residues, overlapping peptides were made. All peptides were synthesized with a N-terminal biotin-tag and used as coating reagents on Streptavidin-coated ELISA plates.

In order to confirm the immunogenicity of selected epitopes, specific antibody levels were measured by peptide ELISA using individual human sera, which were included in the IC9- and IC10 IgG pools used for their identification in bacterial surface display screens. A summary of serum reactivity of 104 peptides present in 61 *E. faecalis* antigens with ten healthy adult screening sera (N1-N10) and eleven sera from patients with different *E. faecalis* infections are shown (P1-P11). The peptides were compared by the score calculated for each peptide based on the number of positive screening sera and the extent of reactivity. Peptides range from highly and widely reactive to weakly positive ones. Among the highest scoring peptide epitopes which are derived from surface proteins, such as LPXTG cell wall proteins (EF0490.3 and EFA0042.1-2), secreted proteins (EF0360.1 and EF0792.1) and also hypothetical proteins (EF0428.1-2, EF3207.2 and EFC0034.1-2) were found. Interestingly, two prominent epitopes belong to alternative reading frames ARF0679 (40 aa long) and ARF2052 (54 aa long) suggesting that these proteins really exist and are expressed in vivo during colonization and/or infection. As it was suggested by lower total *E. faecalis-antibody* levels of the patients' sera relative to the high titer healthy sera (FIG. 1C), peptide reactivities were also lower with the patients' sera.

TABLE 1a

Immunogenic proteins identified by bacterial surface display.

| E. faecalis antigenic protein | Putative function (by homology) | predicted immunogenic aa* | No. of selected clones per ORF and screen | Location of identified immunogenic region (aa) | Seq. ID (DNA, Prot.) |
|---|---|---|---|---|---|
| EF0020 | PTS system component | 4-10, 14-21, 30-36, 59-68, 77-82, 87-93, 96-105, 112-121, 125-133, 135-141, 150-162, 164-183, 192-203, 207-213, 215-226, 228-234, 241-247, 250-285, 302-308 | B: 1, C: 10, D: 1 | 135-148 | 1, 171 |
| EF0032 | membrane protein, putative | 15-57, 60-73, 77-101, 108-134, 136-177, 185-201, 203-217, 226-240, 244-254, 272-277, 283-288, 292-343, 354-370, 380-398, 406-437, 439-453, 473-490, 532-538, 584-590, 595-601, 606-612, 664-677, 679-704, 715-724, 731-753, 759-772, 786-794, 814-862 | A: 1, C: 2 | 657-684 | 2, 172 |
| EF0062 | 2,3-cyclic-nucleotide 2-phosphodiesterase, putative | 4-9, 15-36, 41-47, 54-60, 75-81, 114-120, 131-146, 152-158, 174-182, 194-202, 208-215, 218-226, 255-271, 276-285, 290-295, 302-311, 318-328, 330-344, 352-359, 365-377, 388-395, 398-405, 426-432, 439-449, 455-500, 505-513, 531-537, 542-552, 554-561, 587-595, 606-612, 718-734, 763-771, 775-782, 792-801, 805-812, 822-828, 830-843, 849-863, 876-894, 905-911, 919-926, 935-947, 949-958, 968-979, 1009-1016, 1029-1045, 1047-1056, 1076-1081, 1092-1106, 1123-1133, 1179-1200, 1202-1211, 1215-1223, 1287-1299, 1301-1306 | A: 3, B: 1, C: 16, D: 1 | 398-431, 1224-1237 | 3, 173 |
| EF0149 | aggregation substance ASP1 | 17-47, 74-80, 90-97, 126-133, 137-148, 167-173, 179-185, 214-223, 250-255, 270-283, 329-338, 342-350, 352-358, 360-367, 372-383, 398-404, 411-421, 426-432, 435-446, 452-462, 472-479, 515-521, 582-592, 611-618, 623-629, 642-659, 666-673, 678-689, 704-725, 732-737, 744-757, 768-789, 824-834, 842-849, 862-868, 877-887, 904-916, 923-928, 941-947, 962-974, 982-992, 1019-1030, 1032-1044, 1046-1052, 1065-1075, 1077-1087, 1108-1121, 1124-1132, 1137-1151, 1170-1182, 1190-1206, 1208-1214, 1227-1233, 1242-1251, 1254-1273, 1282-1298 | A: 5, C: 2 | 792-825 | 4, 174 |
| EF0196 | site-specific recombinase family protein | 19-31, 39-67, 82-91, 104-110, 113-128, 149-155, 161-181 | C: 3 | 137-155 | 5, 175 |

TABLE 1a-continued

Immunogenic proteins identified by bacterial surface display.

| E. faecalis antigenic protein | Putative function (by homology) | predicted immunogenic aa* | No. of selected clones per ORF and screen | Location of identified immunogenic region (aa) | Seq. ID (DNA, Prot.) |
|---|---|---|---|---|---|
| EF0253 | aldehyde dehydrogenase | 6-18, 54-63, 69-85, 110-127, 142-156, 158-167, 169-211, 238-246, 248-257, 276-311, 339-349, 371-380, 385-391, 394-403, 421-438, 451-456, 483-489 | C: 2 | 449-468 | 6, 176 |
| EF0270 | PTS system component | 5-15, 24-34, 50-56, 61-83, 98-121, 123-136, 149-162, 166-194, 202-215, 221-227, 229-332, 337-360, 367-402, 404-415, 427-433, 444-462, 471-478, 487-498, 511-518, 521-544, 550-563, 568-574, 580-587, 597-607, 610-616, 624-629 | A: 1, B: 2, C: 2, D: 2 | 468-498 | 7, 177 |
| EF0298 | cation-transporting ATPase, E1-E2 family | 11-19, 32-49, 57-63, 65-71, 80-89, 91-133, 166-181, 183-191, 201-230, 234-257, 264-291, 297-303, 305-314, 316-335, 337-354, 359-366, 368-374, 383-388, 394-405, 408-442, 446-470, 483-490, 499-505, 513-538, 544-555, 557-563, 568-590, 598-608, 617-623, 627-636, 641-647, 667-685, 687-693, 710-723, 733-739, 742-754, 769-815 | D: 24 | 366-388 | 8, 178 |
| EF0355 | endolysin | 4-16, 30-35, 42-53, 67-76, 82-87, 101-108, 112-130, 132-138, 147-152, 161-183, 187-208, 218-225, 265-281, 295-303, 305-317, 322-334, 338-357, 360-368, 370-383, 387-394, 400-419, 421-430 | A: 1, B: 3 | 255-336 | 9, 179 |
| EF0428 | conserved hypothetical protein | 19-27, 36-47, 59-66, 76-83, 101-112, 118-125, 142-147, 162-180, 185-196, 225-240, 246-263, 286-304, 314-319, 327-333, 353-367 | A: 1, C: 23 | 194-214 | 10, 180 |
| EF0485 (EF0005) | aggregation substance | 14-43, 70-76, 83-89, 111-117, 122-128, 136-145, 163-170, 175-182, 210-219, 246-251, 266-279, 325-331, 338-346, 348-354, 356-363, 368-379, 422-428, 431-441, 450-456, 466-473, 509-515, 532-542, 549-556, 576-586, 605-612, 617-623, 636-653, 660-667, 674-686, 698-719, 726-731, 738-745, 762-783, 818-828, 836-843, 856-862, 871-881, 903-910, 917-922, 935-941, 956-968, 976-986, 1013-1024, 1026-1038, 1059-1069, 1071-1081, 1102-1115, 1118-1126, 1131-1145, 1164-1176, 1187-1200, 1202-1208, 1221-1227, 1236-1245, 1248-1267, 1273-1292 | C: 3, D: 4 | 252-287, 805-844 | 11, 181 |
| EF0490 | LPXTG-motif cell wall anchor domain protein | 4-18, 21-28, 37-43, 56-70, 101-113, 131-140, 142-150, 162-170, 172-184, 193-204, 209-227, 233-238, 246-264 | A: 2, C: 10 | 93-168 | 12, 182 |
| EF0517 | 2-dehydropantoate 2-reductase, putative | 14-20, 44-50, 61-70, 77-96, 99-106, 129-142, 168-181, 187-196, 205-221, 225-241, 277-296 | C: 4 | 257-281 | 13, 183 |
| EF0570 | Osmosensitive K+ channel sensor histidine kinase, | 18-29, 43-54, 64-76, 78-84, 88-103, 125-149, 159-176, 198-218, 230-242, 256-271, 279-285, 287-293, 300-306, 325-331, 344-351, 357-364, 371-397, 400-414, 419-464, 485-515, 517-526, 529-537, 548-553, 573-580, 584-590, 603-620, 639-661, 676-681, 687-700, 716-761, 772-780, 785-790, 795-803, 823-836, 848-853 | A: 2 | 106-134 | 14, 184 |
| EF0584 | ABC transporter, ATP-binding protein | 7-13, 19-42, 44-51, 55-75, 87-97, 99-110, 112-118, 129-135, 141-156, 158-178, 213-220, 230-286, 294-308, 323-338, 345-352, 355-365, 370-392, 394-419, 437-446, 454-460, 474-497, 515-526, 528-546, 569-575 | C: 3 | 128-141 | 15, 185 |
| EF0668 | UDP-N-acetylmuramoylalanyl-D-glutamate-2,6-diaminopimelateligase | 12-20, 24-33, 45-70, 73-84, 86-94, 103-116, 118-124, 135-142, 163-170, 176-200, 202-224, 226-234, 237-248, 250-262, 265-287, 296-307, 334-341, 347-356, 361-369, 382-396, 405-415, 418-427, 431-439, 443-449, 452-461, 467-474 | D: 2 | 113-146 | 16, 186 |
| EF0792 | permease, putative | 13-38, 44-50, 52-59, 66-72, 83-94, 103-110, 116-124, 131-137, 158-180, 199-204, 218-233, 241-264, 269-317, 326-342, 350-356 | C: 2 | 70-86 | 17, 187 |
| EF0795 | conserved hypothetical protein | 29-35, 49-59, 63-84, 86-97, 103-111, 113-126, 130-144, 150-158, 174-198, 221-231, 250-264, 266-273, 291-298, 310-318 | A: 1, C: 3 | 70-90 | 18, 188 |
| EF0799 | autolysin | 19-25, 28-52, 60-66, 71-76, 131-142, 149-155, 157-178, 181-213, 218-223, 237-242, 250-257, 260-266, 272-279, 282-290, 321-330, 373-385, 393-407, 441-453, 461-475, 509-521, 529-542, 577-589, 597-610, 643-655, 663-677, 703-718, 729-734 | A: 8, B: 5 | 358-464, 495-570, 604-685 | 19, 189 |
| EF0851 | hypothetical protein | 4-29, 51-76, 116-136, 158-173, 179-193, 207-215 | C: 2 | 86-111 | 20, 190 |
| EF0861 | acetyltransferase, GNAT family | 5-23, 45-70, 79-90, 93-107, 114-122, 142-151 | C: 3 | 18-36 | 21, 191 |
| EF0922 | conserved hypothetical protein | 9-51, 68-120, 133-149, 158-180, 186-206, 211-220, 222-237, 248-293, 296-310, 317-339 | C: 2 | 248-260 | 22, 192 |
| EF0996 | cell division protein FtsA | 14-24, 44-63, 69-98, 108-119, 123-136, 155-161, 164-176, 180-193, 203-208, 215-223, 239-247, 274-281, 283-289, 296-304, 306-313, 315-327, 331-341, 343-353, 357-386, 392-405 | C: 1, D: 3 | 205-246 | 23, 193 |

TABLE 1a-continued

Immunogenic proteins identified by bacterial surface display.

| E. faecalis antigenic protein | Putative function (by homology) | predicted immunogenic aa* | No. of selected clones per ORF and screen | Location of identified immunogenic region (aa) | Seq. ID (DNA, Prot.) |
|---|---|---|---|---|---|
| EF1012 | PTS system component | 5-13, 16-23, 36-42, 53-63, 70-83, 96-102 | C: 2 | 14-34 | 24, 194 |
| EF1026 | conserved hypothetical protein | 4-13, 19-35, 49-56, 59-76, 83-107, 121-134, 144-153, 157-164, 166-186, 194-202, 209-216, 231-253, 257-264 | C: 21 | 98-134 | 25, 195 |
| EF1032 | daunorubicin resistance protein | 16-32, 38-47, 58-68, 78-89, 98-114, 117-123, 132-141, 146-156, 164-170, 179-188, 196-212, 219-230, 232-237, 244-263, 265-274, 278-293, 297-303, 306-326, 339-349, 352-359, 362-367, 373-379, 384-394, 396-406, 423-443, 451-461, 465-484, 490-497, 504-511, 523-533, 537-547, 550-556, 558-566, 573-579, 586-593, 598-609, 615-642, 647-665, 671-686, 693-713, 723-728 | A: 2 | 332-378 | 26, 196 |
| EF1060 | peptide ABC transporter, peptide-binding protein, putative | 6-21, 34-44, 58-64, 66-74, 79-87, 114-127, 129-143, 154-162, 174-189, 205-214, 241-262, 266-273, 278-297, 319-324, 328-338, 342-351, 390-398, 409-415, 422-435, 458-464, 471-477, 481-486, 506-531, 534-540, 542-550 | A: 4 | 315-389 | 27, 197 |
| EF1093 | LPXTG-motif cell wall anchor domain protein | 4-28, 39-45, 52-58, 69-82, 93-115, 122-128, 135-140, 146-163, 177-192, 209-215, 221-232, 271-284, 331-337, 341-352, 360-378, 383-390, 392-401, 409-422, 428-435, 462-470, 474-480, 482-496, 531-539, 541-549, 551-560, 562-569, 576-582, 598-618 | C: 17 | 98-127 | 28, 198 |
| EF1141 | MutT/nudix family protein | 14-27, 33-47, 61-79, 94-104, 119-133 | C: 2 | 36-60 | 29, 199 |
| EF1182 | autoinducer-2 production protein LuxS | 11-22, 29-40, 48-62, 68-73, 96-106, 108-118, 125-149 | C: 3 | 102-126 | 30, 200 |
| EF1277 | transcriptional regulator | 4-11, 45-55, 76-83, 86-102, 105-112, 138-144, 147-153 | D: 9 | 20-48 | 31, 201 |
| EF1289 | conserved domain protein | 12-20, 28-56, 62-68, 72-82, 93-99, 101-107, 120-133, 135-145, 178-186, 208-232, 279-292 | C: 2 | 36-64 | 32, 202 |
| EF1386 | formate/nitrite transporter family protein | 6-14, 23-48, 65-82, 92-134, 140-181, 188-219, 228-238, 244-253, 255-261 | C: 6 | 124-145 | 33, 203 |
| EF1404 | MutS2 family protein | 11-25, 31-38, 53-59, 62-71, 89-99, 125-133, 151-157, 182-190, 195-203, 208-215, 219-229, 249-262, 267-275, 287-295, 298-316, 318-325, 328-334, 344-353, 357-363, 371-377, 385-391, 396-415, 425-436, 438-457, 471-485, 538-552, 554-561, 606-625, 630-636, 646-653, 669-679, 695-704, 706-715, 722-747, 763-773 | C: 6 | 714-738 | 34, 204 |
| EF1561 | shikimate 5-dehydrogenase | 10-29, 33-45, 50-60, 70-79, 83-95, 118-124, 136-157, 176-184, 192-205, 207-216, 223-234, 240-246, 258-268, 275-283 | C: 1, D: 29 | 37-56 | 35, 205 |
| EF1584 | cysteine synthase A | 4-24, 27-38, 46-54, 66-72, 81-97, 112-119, 128-137, 152-157, 173-179, 185-214, 219-225, 227-248, 262-284, 286-295, 301-307 | C: 6 | 117-134 | 36, 206 |
| EF1597 | catalase | 26-43, 49-56, 60-71, 74-82, 87-98, 110-116, 131-146, 154-164, 169-178, 183-189, 205-214, 241-246, 255-268, 275-292, 305-314, 316-323, 326-340, 346-363, 397-402, 419-429, 440-446, 452-461, 467-475 | C: 3 | 29-66 | 37, 207 |
| EF1601 | PTS system component | 7-16, 21-39, 48-58, 61-78, 82-89, 109-136, 138-150, 152-176, 182-247, 255-261, 267-332, 336-345, 347-358, 362-368, 371-392, 394-404, 407-472, 490-498, 505-513, 527-544, 554-582, 603-611, 614-620, 632-638 | A: 1, B: 2, C: 9 | 500-523 | 38, 208 |
| EF1624 | aldehyde dehydrogenase, putative | 24-46, 77-83, 90-97, 99-118, 123-166, 168-177, 204-212, 229-239, 248-262, 273-282, 287-293, 300-319, 321-337, 340-352, 357-366, 391-402, 411-428, 442-450, 464-471, 479-489 | D: 2 | 19-40 | 39, 209 |
| EF1646 | heat shock protein HslVU, ATPase subunit HslU | 9-23, 25-34, 53-58, 70-86, 90-97, 99-116, 118-128, 131-141, 185-191, 228-233, 237-253, 255-261, 264-271, 273-280, 302-312, 319-349, 351-359, 362-369, 376-383, 387-394, 398-406, 419-434 | C: 3 | 20-31 | 40, 210 |
| EF1692 | hypothetical protein | 15-22, 37-43, 71-87, 105-115, 121-127, 135-142, 152-158 | D: 4 | 32-52 | 41, 211 |
| EF1741 | catabolite regulator protein | 6-12, 18-29, 37-47, 50-58, 65-83, 85-91, 94-99, 108-123, 142-150, 156-163, 183-193, 215-222, 242-249, 252-258, 261-270, 285-308, 318-326 | A: 4 | 1-95 | 42, 212 |
| EF1798 | hypothetical protein | 9-61, 65-133, 144-155, 166-173, 175-221, 233-276, 278-313, 329-368 | C: 2 | 210-233 | 43, 213 |
| EF1817 | serine proteinase homolog | 11-29, 33-39, 46-51, 65-93, 107-113, 134-143, 147-154, 166-177, 181-188, 214-220, 233-243, 263-269 | A: 2, B: 1, D: 3 | 112-128 | 44, 214 |
| EF1823 | autolysin | 8-46, 110-134, 155-167, 174-183, 188-201, 210-230, 253-258, 267-282, 289-299, 312-319, 322-327, 330-337, 365-381, 389-402, 405-411, 419-425, 439-447, 465-472, | D: 7 | 503-529 | 45, 215 |

TABLE 1a-continued

Immunogenic proteins identified by bacterial surface display.

| E. faecalis antigenic protein | Putative function (by homology) | predicted immunogenic aa* | No. of selected clones per ORF and screen | Location of identified immunogenic region (aa) | Seq. ID (DNA, Prot.) |
|---|---|---|---|---|---|
| | | 489-512, 525-532, 540-554, 577-589, 591-599, 605-614, 616-624, 633-649 | | | |
| EF1978 | DNA-3-methyladenine glycosylase | 34-49, 64-70, 90-118, 124-131, 141-152, 159-165 | C: 6 | 112-128 | 46, 216 |
| EF2005 | conserved hypothetical protein | 5-15, 26-45, 55-72, 80-85, 93-100, 121-133, 142-148, 154-167, 198-205, 209-215, 241-254, 260-265, 271-279 | C: 2 | 244-270 | 47, 217 |
| EF2052 | cell division protein FtsK | 4-36, 38-54, 67-83, 122-153, 159-178, 205-212, 232-242, 244-253, 259-268, 281-288, 298-309, 324-331, 334-370, 372-381, 389-401, 403-429, 441-450, 456-462, 465-471, 473-479, 483-504, 508-518, 537-543, 553-565, 578-584, 592-609, 619-625, 658-667, 669-679, 712-719, 722-729, 737-744, 746-752, 758-765 | C: 6 | 180-226 | 48, 218 |
| EF2074 | ABC transporter, ATP-binding protein | 6-17, 23-32, 49-56, 61-67, 76-83, 85-103, 105-111, 120-132, 145-171, 175-185, 191-225, 231-246 | C: 23 | 99-128 | 49, 219 |
| EF2266 | 2-deydro-3-deoxyphosphogluconate aldolase | 4-24, 28-48, 52-58, 64-79, 87-100, 104-120, 136-152, 159-166 | C: 4 | 150-163 | 50, 220 |
| EF2305 | toprim domain protein | 15-27, 65-71, 77-99, 104-121, 128-154, 183-216, 223-229, 234-255, 277-287, 296-308 | C: 10 | 77-97 | 51, 221 |
| EF2306 | conserved hypothetical protein | 8-18, 44-76, 102-109 | C: 2 | 49-57 | 52, 222 |
| EF2307 | conserved hypothetical protein | 5-14, 28-40, 42-51, 54-60, 77-83, 89-100, 117-124, 146-172, 176-204, 216-231, 237-244, 267-278, 324-334, 342-348, 396-401, 427-433, 438-450, 452-457, 465-471, 473-481, 491-500, 509-515, 523-544, 550-556, 558-569, 589-595, 606-618, 625-632, 640-649, 665-671, 678-688, 691-698, 717-723, 728-734, 781-789, 800-805, 812-821, 833-868, 873-879, 889-905, 929-939, 988-998, 1046-1061, 1073-1079, 1089-1096, 1115-1124, 1132-1140, 1172-1196, 1220-1226, 1231-1249, 1269-1277, 1287-1301, 1307-1330, 1350-1361, 1369-1378, 1387-1412, 1414-1420, 1422-1439, 1484-1491, 1513-1529, 1552-1561, 1576-1583, 1606-1613, 1617-1640, 1647-1654, 1665-1679, 1686-1698, 1709-1727, 1736-1743, 1750-1757, 1771-1790, 1801-1807, 1817-1823, 1831-1842, 1859-1868, 1870-1882, 1884-1891, 1900-1906, 1909-1914, 1929-1935, 1952-1960, 1974-1988, 2002-2011, 2032-2063, 2071-2081, 2116-2124, 2139-2147, 2149-2159, 2163-2190, 2209-2215, 2245-2253, 2282-2287, 2331-2342, 2360-2370, 2379-2393, 2402-2408, 2414-2421, 2423-2430, 2433-2439, 2442-2450, 2472-2478, 2485-2493, 2495-2503, 2506-2512, 2547-2554, 2558-2564, 2615-2625, 2637-2652, 2692-2698, 2700-2706, 2711-2723, 2731-2740, 2748-2753, 2756-2762, 2765-2772, 2781-2798, 2810-2824, 2844-2852, 2885-2899, 2912-2922, 2937-2944, 2947-2970, 2988-2998, 3016-3025, 3032-3037, 3062-3071, 3129-3148, 3156-3161 | A: 8, B: 1, C: 2, | 530-607 | 53, 223 |
| EF2326 | reverse transcriptase | 31-36, 57-62, 79-85, 90-96, 99-112, 120-146, 162-185, 193-203, 208-217, 219-226, 239-253, 283-290, 298-304, 306-321, 340-349, 351-361, 365-372, 386-395, 407-438, 473-486, 537-551, 558-568, 576-594, 598-604 | D: 40 | 75-95 | 54, 224 |
| EF2378 | DNA polymerase III, alpha subunit, Gram-positive type | 14-19, 24-30, 34-42, 45-52, 54-64, 66-82, 95-105, 107-118, 126-163, 171-177, 184-201, 210-215, 260-269, 273-279, 288-304, 321-327, 358-364, 370-375, 380-387, 394-404, 407-413, 421-431, 436-451, 465-474, 504-511, 531-552, 578-587, 614-626, 629-636, 638-671, 691-715, 719-729, 733-745, 752-759, 768-777, 785-792, 794-802, 805-824, 844-854, 867-880, 885-891, 893-902, 907-924, 939-948, 955-964, 966-975, 987-1000, 1012-1017, 1023-1028, 1050-1071, 1083-1098, 1102-1115, 1133-1146, 1170-1183, 1204-1211, 1213-1223, 1262-1311, 1313-1319, 1346-1355, 1366-1371, 1383-1405, 1409-1414 | D: 38 | 776-819 | 55, 225 |
| EF2476 | penicillin-binding protein 2, putative | 12-27, 30-38, 54-61, 64-74, 82-96, 103-110, 117-125, 134-140, 147-158, 185-201, 218-225, 232-253, 265-280, 319-325, 350-362, 366-372, 376-386, 464-483, 485-490, 511-521, 531-537, 542-559, 564-574, 593-609, 613-619, 637-642, 668-677 | A: 3, C: 8 | 195-214 | 56, 226 |
| EF2556 | succinate dehydrogenase/ fumarate reductase, flavoprotein subunit | 4-21, 59-67, 73-79, 84-91, 141-151, 186-197, 203-214, 222-227, 237-245, 255-260, 281-292, 294-311, 336-344, 346-355, 422-437, 459-466, 484-491 | A: 1, C: 3 | 77-109 | 57, 227 |

TABLE 1a-continued

Immunogenic proteins identified by bacterial surface display.

| E. faecalis antigenic protein | Putative function (by homology) | predicted immunogenic aa* | No. of selected clones per ORF and screen | Location of identified immunogenic region (aa) | Seq. ID (DNA, Prot.) |
|---|---|---|---|---|---|
| EF2563 | conserved hypothetical protein | 10-45, 52-61, 63-70, 74-102, 112-122, 124-132, 164-178, 181-205, 212-240, 246-256 | C: 2 | 226-247 | 58, 228 |
| EF2570 | xanthine dehydrogenase | 38-50, 53-63, 78-87, 89-111, 126-152, 169-176, 179-186, 193-228, 254-267, 275-282, 288-304, 309-318, 325-341, 346-353, 358-367, 384-395, 404-427, 429-435, 456-465, 467-501, 510-521, 523-536, 541-548, 552-560, 563-584, 589-595, 597-620, 625-637, 639-645, 661-666, 712-729, 734-741, 743-750, 775-806, 809-816, 818-840, 842-850 | C3 | 693-714 | 59, 229 |
| EF2581 | oxidoreductase, pyridine nucleotide-disulfide | 5-17, 30-37, 52-75, 77-86, 88-107, 112-135, 151-160, 178-222, 226-246, 263-270, 279-294, 306-314, 327-342, 345-352, 374-381, 389-416, 422-429, 435-449, 453-467, 473-500, 512-522, 524-531, 542-549, 552-560, 565-571, 575-586, 594-600, 613-619, 625-633, 635-641, 647-653, 667-674, 680-699, 711-729, 735-741, 764-775, 781-786, 792-798, 805-813, 817-825, 833-842, 850-855, 860-866, 869-910, 917-930, 949-990 | A: 1, C: 7 | 533-562 | 60, 230 |
| EF2617 | ribonuclease R | 7-14, 39-46, 61-74, 83-89, 93-99, 110-121, 136-150, 172-180, 182-200, 207-216, 223-236, 238-251, 265-271, 280-288, 294-309, 320-336, 339-354, 362-377, 383-389, 401-407, 435-441, 446-453, 460-465, 472-487, 499-511, 518-528, 533-540, 557-570, 572-587, 631-637, 643-658, 663-669, 672-678, 681-687, 695-706, 714-728 | C: 2 | 118-139 | 61, 231 |
| EF2682 | conserved hypothetical protein | 5-19, 24-30, 56-64, 69-79, 93-100, 102-111, 117-123, 125-133, 174-182, 185-199, 205-224, 268-275, 311-336 | D: 20 | 102-125 | 62, 232 |
| EF2703 | transcriptional regulator | 6-35, 39-45, 57-62, 80-85, 92-106, 117-122, 126-171, 214-223, 253-260, 268-273, 285-291, 295-306, 315-320, 325-336, 361-366 | A: 1, B: 2, D: 12 | 172-202 | 63, 233 |
| EF2724 | endoglucanase, putative | 4-13, 24-37, 45-51, 58-66, 84-92, 112-121, 132-141, 151-171, 175-195, 204-212, 222-240, 262-268, 276-295, 305-336, 338-348, 354-362 | C: 2 | 160-183 | 64, 234 |
| EF2782 | galactose-1-phosphate uridylyltransferase | 10-16, 24-35, 41-73, 78-104, 111-121, 124-139, 141-148, 150-164, 196-215, 224-241, 249-282, 299-307, 315-357, 368-378, 393-401 | D: 2 | 345-367 | 65, 235 |
| EF2787 | rhodanese family protein | 4-32, 48-53, 61-67, 84-104, 112-118 | D: 21 | 106-130 | 66, 236 |
| EF2812 | hypothetical protein | 21-28, 31-36, 65-81, 98-105, 115-121, 123-131, 136-142, 155-161, 177-190 | D: 15 | 201-232 | 67, 237 |
| EF2858 | threonyl-tRNA synthetase | 4-15, 21-27, 33-39, 42-56, 58-64, 68-82, 84-90, 92-98, 113-122, 146-162, 168-175, 177-189, 191-203, 249-268, 279-285, 287-304, 328-342, 349-358, 371-378, 387-393, 404-413, 419-425, 467-479, 487-498, 513-524, 528-539, 541-565, 572-579, 595-606, 626-635, 637-642 | C: 8 | 612-626 | 68, 238 |
| EF2893 | hypothetical protein | 7-13, 52-70, 76-82, 97-106, 110-117 | D: 6 | 13-45 | 69, 239 |
| EF2927 | hydrolase, haloacid dehalogenase-like family | 5-10, 12-48, 59-64, 87-102, 107-128, 131-140, 154-161, 165-171, 173-215 | C: 2 | 54-74 | 70, 240 |
| EF2951 | hypothetical protein | 4-11, 19-28, 34-40, 74-81, 87-98, 126-147, 163-171, 184-193, 205-213 | B: 1, C: 2 | 49-124 | 71, 241 |
| EF2961 | ribokinase | 7-14, 23-29, 35-40, 61-67, 99-106, 111-122, 124-133, 135-161, 187-206, 216-229, 236-245, 262-268, 271-280 | C: 2 | 256-273 | 72, 242 |
| EF2986 | ABC transporter, ATP-binding protein | 4-13, 17-37, 47-54, 85-99, 105-113, 120-132, 147-166, 180-186, 192-199, 204-216 | C: 2 | 127-144 | 73, 243 |
| EF2987 | conserved hypothetical protein | 14-27, 29-37, 52-62, 68-76, 89-96, 117-123, 125-131, 137-145, 166-195, 205-212, 214-222, 228-235, 258-264, 271-281, 288-296, 308-324, 332-339, 355-361, 365-371 | A: 1, C: 2 | 268-293 | 74, 244 |
| EF3023 | polysaccharide lyase, family 8 | 4-21, 30-42, 54-60, 78-85, 90-110, 141-147, 160-168, 176-185, 194-206, 218-225, 230-245, 251-261, 287-293, 295-304, 320-326, 334-347, 351-362, 386-402, 413-423, 427-433, 439-453, 456-477, 480-493, 507-513, 526-539, 574-581, 591-598, 600-609, 614-632, 655-665, 685-691, 703-712, 742-747, 757-775, 797-803, 813-819, 823-829, 880-887, 901-906, 930-944, 948-958, 962-968, 971-995, 1002-1009, 1017-1023, 1036-1053, 1069-1081, 1107-1124, 1129-1152, 1178-1195, 1211-1223, 1249-1266, 1271-1288, 1334-1340, 1346-1367 | A: 9, D: 6 | 1-63, 171-189 | 75, 245 |
| EF3041 | peptide ABC transporter, peptide-binding protein | 4-22, 52-63, 70-75, 94-104, 112-125, 133-141, 176-199, 209-216, 244-259, 287-299, 336-352, 366-372, 386-399, 421-436, 444-449, 457-466, 481-487, 506-529, 531-540 | A: 2, B: 1 | 295-378 | 76, 246 |
| EF3051 | hypothetical protein | 9-30, 43-49, 58-75, 86-96, 119-131, 138-147, 162-167, 181-201, 208-214 | A: 4, C: 3 | 16-121 | 77, 247 |

TABLE 1a-continued

Immunogenic proteins identified by bacterial surface display.

| E. faecalis antigenic protein | Putative function (by homology) | predicted immunogenic aa* | No. of selected clones per ORF and screen | Location of identified immunogenic region (aa) | Seq. ID (DNA, Prot.) |
|---|---|---|---|---|---|
| EF3060 | secreted antigen SagA, putative | 4-27, 52-58, 80-90, 92-100, 108-114, 118-143, 169-176, 189-198, 247-261, 281-287, 307-317, 323-329, 352-363, 372-381, 396-411, 413-426, 429-440, 442-450, 456-461, 468-479 | A: 14, B: 6, C: 1 | 1-73 | 78, 248 |
| EF3073 | Signal peptidase I | 4-32, 47-52, 57-63, 71-78, 92-104, 126-142, 153-175 | B: 3, C: 3 | 145-163 | 79, 249 |
| EF3086 | conserved hypothetical protein | 17-23, 35-41, 51-70, 73-86, 104-125 | C: 2 | 105-129 | 80, 250 |
| EF3096 | chromosome segregation SMC protein, putative | 25-32, 41-50, 75-85, 87-103, 115-122, 138-149, 164-171, 188-210, 212-220, 224-234, 256-273, 288-299, 304-310, 330-336, 357-365, 382-390, 399-405, 414-421, 440-446, 454-461, 480-486, 502-514, 518-540, 543-553, 561-567, 572-580, 582-588, 595-630, 633-651, 672-681, 691-709, 760-767, 813-832, 841-848, 852-866, 873-893, 919-925, 927-933, 940-955, 957-978, 984-997, 1000-1010, 1035-1040, 1044-1051, 1058-1064, 1081-1091, 1097-1124, 1129-1138, 1144-1150, 1158-1165, 1170-1180 | C: 14 | 909-936, 1001-1031 | 81, 251 |
| EF3125 | primosomal protein N | 4-12, 19-26, 31-41, 49-64, 66-86, 101-117, 119-127, 134-142, 152-161, 163-172, 179-188, 209-218, 234-241, 276-291, 294-300, 307-320, 324-341, 346-356, 373-387, 389-397, 410-416, 418-436, 444-454, 460-472, 481-486, 500-507, 511-535, 541-549, 553-559, 579-586, 602-607, 613-620, 628-640, 654-663, 671-678, 681-691, 709-722, 741-754, 766-774, 778-786, 797-803 | C: 4 | 212-226 | 82, 252 |
| EF3177 | hypothetical protein | 4-10, 15-27, 34-54, 60-73, 79-88, 101-115, 120-136, 154-162, 167-172, 222-240 | A: 3 | 126-195 | 83, 253 |
| EF3183 | LPXTG-motif cell wall anchor domain protein | 5-16, 18-25, 29-35, 57-63, 86-91, 107-121, 123-131, 170-179, 185-199, 204-226, 250-255, 262-274, 291-296, 325-347 | A: 2, B: 1 | 1-38 | 84, 254 |
| EF3207 | conserved hypothetical protein | 7-19, 22-34, 36-42, 48-54, 60-66, 71-76, 104-110, 118-133, 135-145, 158-164, 167-174, 182-193, 196-204, 217-229, 251-290, 293-299, 309-315 | C: 1, D: 5 | 288-318 | 85, 255 |
| EF3276 | conserved hypothetical protein | 43-51, 55-61, 66-73, 80-90, 103-127, 133-142, 174-180, 185-196, 203-210, 229-235, 239-251, 258-266, 272-278, 289-314, 316-326, 340-346, 355-361 | A: 1 | 14-27 | 86, 256 |
| EF3290 | sensor histidine kinase | 4-25, 27-33, 35-41, 52-74, 76-89, 99-124, 138-144, 146-159, 167-182, 184-191, 193-206, 211-223, 232-240, 249-257, 270-279, 281-287, 293-310, 322-341, 347-356 | C: 14 | 292-322 | 87, 257 |
| EF3295 | hypothetical protein | 5-13, 28-38, 43-60, 67-72, 98-116, 122-134, 137-151, 167-174, 177-195, 197-216 | B: 1, C: 4 | 99-195 | 88, 258 |
| EF3319 | citrate lyase, alpha subunit | 15-33, 35-42, 48-57, 62-68, 73-91, 107-119, 121-153, 173-194, 205-210, 223-228, 234-241, 243-259, 275-298, 308-315, 327-340, 342-370, 376-391, 398-404, 410-419 | A: 1, C: 50 | 71-122 | 89, 259 |
| EFB0002 | transposase | 12-39, 43-64, 87-95, 99-105, 114-126, 128-136, 139-147, 212-225 | A: 1, C: 3 | 107-141 | 90, 260 |
| EFA0041 | conserved hypothetical protein | 6-33, 40-45, 60-75, 79-86, 121-129, 131-137, 161-167, 172-178, 186-195, 203-212, 236-244, 257-264, 278-294, 306-312, 345-358, 368-381, 386-395, 404-410, 412-418 | A: 4, B: 5, D: 3 | 198-270 | 91, 261 |
| EFA0042 | LPXTG-motif cell wall anchor domain protein | 18-31, 34-41, 50-56, 69-83, 99-106, 129-141, 147-153, 159-168, 170-178, 190-198, 200-212, 221-232, 237-255, 261-266, 274-292 | A: 3, B: 2, C: 26 | 118-216 | 92, 262 |
| EFA0047 | aggregation substance precursor | 17-47, 61-67, 87-93, 115-121, 126-132, 140-148, 167-173, 179-186, 214-223, 250-255, 264-272, 282-294, 306-318, 338-353, 358-377, 385-401, 414-420, 433-441, 451-457, 470-480, 505-511, 544-550, 571-581, 600-607, 612-618, 631-648, 655-662, 669-681, 693-714, 721-726, 733-740, 757-778, 813-823, 831-838, 851-857, 866-876, 893-905, 912-917, 930-936, 951-963, 971-981, 1008-1019, 1021-1033, 1035-1041, 1054-1064, 1066-1076, 1097-1110, 1113-1121, 1126-1140, 1159-1171, 1181-1195, 1197-1203, 1216-1222, 1231-1240, 1243-1262, 1268-1287 | A: 4, D: 2 | 738-828 | 93, 263 |
| EFC0015 | hypothetical protein | 19-28, 40-46, 51-57, 68-74, 81-87, 98-108, 111-121 | D: 3 | 20-36 | 94, 264 |
| EFC0025 | hypothetical protein | 4-17, 19-44, 60-69, 80-86, 110-116 | A: 1, B: 1, C: 2 | 33-60 | 95, 265 |
| EFC0034 | hypothetical protein | 8-16, 18-28, 42-50, 53-75, 79-86, 94-99, 122-128, 136-142, 149-163, 166-173, 198-212, 254-272, 288-295, 304-318, 324-329, 343-348, 351-364, 367-383, 389-395, 411-420, 427-436 | C: 10, D: 150 | 11-56 | 96, 266 |
| ARFC0021.1 | conserved domain protein | 19-25 | D: 5 | 6-24 | 97, 267 |
| ARFC0021.2 | conserved domain protein | 6-39, 59-68 | D: 3 | 44-63 | 98, 268 |
| ARF0031 | hypothetical protein | 5-14, 21-28, 38-53 | B: 1, C: 2 | 29-41 | 99, 269 |
| ARF0066 | hypothetical protein | 4-13, 31-41, 56-65 | C: 14 | 32-56 | 100, 270 |

TABLE 1a-continued

Immunogenic proteins identified by bacterial surface display.

| E. faecalis antigenic protein | Putative function (by homology) | predicted immunogenic aa* | No. of selected clones per ORF and screen | Location of identified immunogenic region (aa) | Seq. ID (DNA, Prot.) |
|---|---|---|---|---|---|
| ARF0076 | hypothetical protein | 5-12 | A: 1, C: 8 | 4-21 | 101, 271 |
| ARF0180 | hypothetical protein | 4-18 | A: 1, C: 15 | 17-32 | 102, 272 |
| ARF0275 | hypothetical protein | 4-10, 23-33 | C: 2 | 14-30 | 103, 273 |
| ARF0283 | hypothetical protein | 26-34, 44-53 | D: 2 | 35-52 | 104, 274 |
| ARF0375 | hypothetical protein | none | C: 3 | 1-19 | 105, 275 |
| ARF0679 | hypothetical protein | 4-17, 23-30, 32-37 | D: 17 | 6-23 | 106, 276 |
| ARF0721 | hypothetical protein | 5-33, 40-58, 61-66 | C: 6 | 45-66 | 107, 277 |
| ARF1090 | hypothetical protein | 15-41, 61-67 | C: 5 | 41-65 | 108, 278 |
| ARF1583 | hypothetical protein | 4-12, 16-23, 26-37 | C: 4 | 10-29 | 109, 279 |
| ARF2052 | hypothetical protein | 23-39 | C: 37 | 37-55 | 110, 280 |
| ARF2125 | hypothetical protein | 12-20 | D: 8 | 38-55 | 111, 281 |
| ARF2307.1 | hypothetical protein | 22-37 | C: 4 | 7-22 | 112, 282 |
| ARF2307.2 | hypothetical protein | none | C: 2 | 3-14 | 113, 283 |
| ARF2323 | hypothetical protein | 6-16, 43-65, 71-76 | C: 14 | 17-31 | 114, 284 |
| ARF2505 | hypothetical protein | 4-13, 27-39, 42-69 | B: 1, C: 2 | 17-32 | 115, 285 |
| ARF2802 | hypothetical protein | 4-12, 26-39 | A: 1, B: 1, C: 3 | 10-25 | 116, 286 |
| ARF2902 | hypothetical protein | none | C: 2 | 2-31 | 117, 287 |
| ARF3079 | hypothetical protein | 6-38, 49-62 | D: 4 | 39-55 | 118, 288 |
| ARF3157 | hypothetical protein | 4-10, 24-30 | A: 1, C: 2 | 2-19 | 119, 289 |
| ARF3182 | hypothetical protein | 12-17, 25-46 | A: 2, C: 2 | 15-30 | 120, 290 |
| ARF3314 | hypothetical protein | 4-13 | A: 2, B: 1, C: 3, D: 1 | 2-28 | 121, 291 |
| ARFA0022 | hypothetical protein | 30-38 | C: 2 | 17-45 | 122, 292 |
| CRF0022 | hypothetical protein | 24-33, 55-61 | C: 6 | 31-61 | 123, 293 |
| CRF0073 | hypothetical protein | 4-26, 34-48 | D: 2 | 15-33 | 124, 294 |
| CRF0096 | hypothetical protein | 9-15 | D: 3 | 1-22 | 125, 295 |
| CRF0115 | hypothetical protein | 4-31 | C: 2 | 14-33 | 126, 296 |
| CRF0202 | hypothetical protein | 5-34, 49-55, 64-82 | C: 3 | 69-83 | 127, 297 |
| CRF0249 | hypothetical protein | 33-45 | D: 2 | 21-39 | 128, 298 |
| CRF0258 | hypothetical protein | 7-14, 24-32, 42-65, 79-86 | C: 3 | 50-64 | 129, 299 |
| CRF0264 | hypothetical protein | 13-27, 33-43, 45-62 | C: 3 | 12-37 | 130, 300 |
| CRF0339 | hypothetical protein | 4-15, 17-32 | C: 3 | 10-26 | 131, 301 |
| CRF0399 | hypothetical protein | 4-9, 11-43, 45-75 | C: 4 | 47-69 | 132, 302 |
| CRF0682 | hypothetical protein | 4-18, 22-37 | C: 12 | 17-34 | 133, 303 |
| CRF0783 | hypothetical protein | 4-14 | D: 6 | 5-24 | 134, 304 |
| CRF0801 | hypothetical protein | 7-33, 35-46 | C: 31 | 1-19 | 135, 305 |
| CRF0892 | hypothetical protein | 13-37, 69-75 | C: 9 | 51-69 | 136, 306 |
| CRF1041 | hypothetical protein | 14-24, 26-34, 37-49, 66-78 | C: 5 | 2-25 | 137, 307 |
| CRF1049 | hypothetical protein | 17-46, 52-57, 59-64 | C: 3 | 54-68 | 138, 308 |
| CRF1327 | hypothetical protein | 4-22 | C: 2 | 13-25 | 139, 309 |
| CRF1593 | hypothetical protein | 8-40, 53-63 | D: 3 | 29-50 | 140, 310 |
| CRF1610 | hypothetical protein | 16-28 | C: 2 | 32-40 | 141, 311 |
| CRF1732 | hypothetical protein | 14-20, 22-28, 39-45 | C: 5, D: 9 | 2-22 | 142, 312 |
| CRF1830 | hypothetical protein | 4-13 | C: 2 | 12-31 | 143, 313 |
| CRF1992 | hypothetical protein | 15-21 | D: 11 | 2-17 | 144, 314 |
| CRF2074 | hypothetical protein | 4-17 | D: 2 | 20-36 | 145, 315 |
| CRF2099 | hypothetical protein | 4-19 | C: 2 | 9-18 | 146, 316 |
| CRF2298 | hypothetical protein | 4-14 | D: 2 | 3-19 | 147, 317 |
| CRF2318 | hypothetical protein | 4-21, 32-40 | C: 2 | 21-39 | 148, 318 |
| CRF2568 | hypothetical protein | 4-13 | C: 2 | 10-27 | 149, 319 |
| CRF2573 | hypothetical protein | 18-31, 39-47, 75-87, 89-98 | C: 3 | 79-99 | 150, 320 |
| CRF2581 | hypothetical protein | 15-21 | C: 12, D: 29 | 9-24 | 151, 321 |
| CRF2647 | hypothetical protein | 4-14, 18-27, 30-53, 55-64, 68-74, 81-98 | C: 7 | 22-40 | 152, 322 |
| CRF2706 | hypothetical protein | 7-24, 44-51 | C: 2 | 35-60 | 153, 323 |
| CRF2751 | hypothetical protein | 10-47 | C: 3 | 23-37 | 154, 324 |
| CRF2768 | hypothetical protein | 4-10, 12-46 | C: 3 | 7-22 | 155, 325 |
| CRF2778 | hypothetical protein | 20-27 | C: 3 | 1-13 | 156, 326 |
| CRF2790 | hypothetical protein | 6-19, 41-51 | C: 12 | 9-37 | 157, 327 |
| CRF2899 | hypothetical protein | 4-9, 11-17 | C: 2 | 9-23 | 158, 328 |
| CRF2935 | hypothetical protein | 4-17, 23-38, 46-66, 68-85 | D: 26 | 34-46 | 159, 329 |
| CRF2966 | hypothetical protein | 4-18, 34-59, 75-81 | D: 31 | 61-84 | 160, 330 |
| CRF3074 | hypothetical protein | 6-17 | C: 2 | 7-28 | 161, 331 |
| CRF3084 | hypothetical protein | 4-32, 56-61 | D: 6 | 35-52 | 162, 332 |
| CRF3120 | hypothetical protein | 4-14, 27-71, 74-88, 93-110, 115-120, 124-130, 139-154, 161-172 | C: 4 | 146-171 | 163, 333 |
| CRF3276 | hypothetical protein | 4-21 | C: 39 | 3-15 | 164, 334 |
| CRF3277 | hypothetical protein | 12-17 | C: 11 | 9-26 | 165, 335 |
| CRF3281 | hypothetical protein | 10-21, 45-58 | C: 3 | 51-67 | 166, 336 |
| CRF3285 | hypothetical protein | 59-66, 68-84 | D: 2 | 13-42 | 167, 337 |
| CRFC0021 | hypothetical protein | 11-16 | C: 3 | 1-16 | 168, 338 |

TABLE 1a-continued

Immunogenic proteins identified by bacterial surface display.

| E. faecalis antigenic protein | Putative function (by homology) | predicted immunogenic aa* | No. of selected clones per ORF and screen | Location of identified immunogenic region (aa) | Seq. ID (DNA, Prot.) |
|---|---|---|---|---|---|
| CRFC0046 | hypothetical protein | 4-19, 23-37 | C: 4 | 10-30 | 169, 339 |
| NRF0001 | hypothetical protein | 19-27, 35-46, 48-66, 82-88, 99-105, 113-119 | C: 1 | 42-59 | 170, 340 |

TABLE 1b

E. faecium proteins identified by homology search with identified E. faecalis antigens

| E. faecium | Putative function (by homology to E. faecalis) | E. faecalis antigenic protein | Seq. ID (DNA, Prot.) | Identity to E. faecalis (%) | Seq. ID (DNA, Prot.) |
|---|---|---|---|---|---|
| EFN0001 | PTS system component | EF0020 | 1, 171 | 78 | 341, 357 |
| EFN0002 | conserved hypothetical protein | EF0428 | 10, 180 | 80 | 342, 358 |
| EFN0003 | 2-dehydropantoate 2-reductase, putative | EF0517 | 13, 183 | 77 | 343, 359 |
| EFN0004 | conserved hypothetical protein | EF0795 | 18, 188 | 80 | 344, 360 |
| EFN0005 | cell division protein FtsA | EF0996 | 23, 193 | 78 | 345, 361 |
| EFN0006 | PTS system component | EF1012 | 24, 194 | 87 | 346, 362 |
| EFN0007 | LPXTG-motif cell wall anchor domain protein | EF1093 | 28, 198 | 74 | 347, 363 |
| EFN0008 | MutS2 family protein | EF1404 | 34, 204 | 77 | 348, 364 |
| EFN0009 | catabolite regulator protein | EF1741 | 42, 212 | 80 | 349, 365 |
| EFN0010 | 2-deydro-3-deoxyphosphogluconate aldolase | EF2266 | 50, 220 | 76 | 350, 366 |
| EFN0011 | DNA polymerase III, alpha subunit, Gram-positive type | EF2378 | 55, 225 | 82 | 351, 367 |
| EFN0012 | rhodanese family protein | EF2787 | 66, 236 | 70 | 352, 368 |
| EFN0013 | threonyl-tRNA synthetase | EF2858 | 68, 238 | 89 | 353, 369 |
| EFN0014 | conserved hypothetical protein | EF3207 | 85, 255 | 85 | 354, 370 |
| EFN0015 | sensor histidine kinase | EF3290 | 87, 257 | 73 | 355, 371 |
| EFN0016 | transposase | EFB0002 | 90, 260 | 83 | 356, 372 |

TABLE 1c

Immunogenic proteins identified with sera from endocarditis patients by bacterial surface display.

| E. faecalis antigenic protein | Putative function (by homology) | predicted immunogenic aa* | No. of selected clones per ORF and screen | Location of identified immunogenic region (aa) | Seq. ID (DNA, Prot.) |
|---|---|---|---|---|---|
| EF0008 | single-strand binding protein | 4-11, 16-34, 48-55, 67-77, 87-106 | E: 8 | 153-183 | 373, 425 |
| EF0028 | PTS system component | 22-40, 49-65, 70-91, 95-109, 111-125, 146-207, 209-216, 219-225, 229-244, 251-270, 274-286, 292-309, 316-329, 335-355, 358-370, 376-388, 392-419, 425-430, 435-441, 448-455, 464-478, 486-515 | F: 1 | 437-465 | 374, 426 |
| EF0146 | surface exclusion protein Sea1 putative | 5-19, 25-31, 43-48, 60-79, 88-100, 105-129, 148-171, 187-193, 243-263, 316-322, 334-340, 345-351, 369-378, 381-391, 399-404, 474-483, 502-517, 525-530, 558-568, 579-596, 622-627, 631-638, 644-651, 653-660, 674-680, 687-693, 721-728, 743-753, 760-775, 788-795, 806-813, 821-828, 835-842, 847-859, 868-887 | F: 13, H: 3 | 300-347 | 375, 427 |
| EF0153 | LPXTG-motif cell wall anchor domain protein | 5-26, 37-44, 89-97, 112-118, 121-128, 138-154, 157-165, 176-181, 188-198, 205-218, 223-243, 247-253, 260-279 | H: 1 | 76-155 | 376, 428 |
| EF0394 | 44% homology to secreted antigen SagA e. feacium | 4-29, 41-46, 49-68, 82-88, 121-147, 158-164, 187-193, 195-208, 229-236, 244-249, 251-263, 269-275, 307-313, 337-343, 348-381, 392-398, 402-408, 432-438 | E: 96, G: 2 | 85-117, 194-239 | 377, 429 |
| EF0443 | homology to LysM domain protein | 5-12, 14-22, 28-34, 40-46, 70-79, 84-129, 152-165, 174-182 | G: 2 | 37-109 | 378, 430 |
| EF0568 | potassium-transporting ATPase subunit B | 5-16, 18-52, 54-72, 81-86, 118-126, 136-145, 151-157, 168-180, 209-233, 244-270, 295-302, 315-326, 329-337, 345-352, 364-373, 397-402, 408-418, 424-431, 435-443, 472-480, 483-489, 504-510, 519-527, 549-564, 576-599, 605-637, 641-673 | E: 2 | 91-98 | 379, 431 |
| EF0591 | lipoprotein putative | 23-36, 42-52, 133-140, 151-157, 242-247, 267-277, 295-301, 320-328, 333-339, 345-352, 365-371, 397-403, 415-428, 456-465, 481-487, 489-495, 508-516, 518-527, 585-592, 606-614, | F: 3 | 307-340 | 380, 432 |

TABLE 1c-continued

Immunogenic proteins identified with sera from endocarditis patients by bacterial surface display.

| E. faecalis antigenic protein | Putative function (by homology) | predicted immunogenic aa* | No. of selected clones per ORF and screen | Location of identified immunogenic region (aa) | Seq. ID (DNA, Prot.) |
|---|---|---|---|---|---|
| | | 631-637, 643-658, 665-670, 723-728, 737-744, 752-759, 787-793, 835-841, 873-885, 918-928, 938-945, 951-966, 978-988, 1015-1020, 1030-1036, 1044-1052, 1058-1069, 1071-1079, 1081-1088, 1113-1119, 1125-1138, 1141-1147, 1164-1170, 1172-1177, 1190-1200, 1214-1220, 1230-1236, 1239-1245, 1262-1268, 1270-1275, 1288-1298, 1312-1318, 1328-1334, 1337-1343, 1360-1366, 1368-1373, 1386-1396, 1410-1416, 1426-1432, 1435-1441, 1458-1464, 1466-1471, 1484-1494, 1508-1514, 1524-1530, 1533-1539, 1556-1562 | | | |
| EF0592 | LPXTG-motif cell wall anchor domain protein (repeat domains) | 19-25, 35-41, 44-50, 66-72, 74-79, 92-102, 116-122, 132-138, 141-147, 164-170, 172-177, 190-200, 214-220, 230-236, 239-245, 262-268, 270-275, 288-298, 312-318, 328-334, 337-343, 360-366, 368-373, 386-396, 410-416, 426-432, 435-441, 458-464, 466-478, 504-524 | H: 1 | 79-148, 177-246, 275-344, 373-442 | 381, 433 |
| EF0658 | hypothetical protein | 7-14, 16-23, 33-39, 46-53, 72-79, 92-115, 123-130, 156-175, 179-187, 214-220, 239-246, 266-274, 302-325, 338-354, 360-370, 375-390, 392-401, 421-428, 430-463 | F: 2 | 29-58 | 382, 434 |
| EF0727 | conserved hypothetical protein | 4-9, 22-39, 58-65, 72-82, 87-92, 99-104, 107-119, 143-166, 171-177, 194-202, 205-213, 220-228, 231-240, 247-263, 309-315, 317-323, 336-343 | E: 1 | 294-320 | 383, 435 |
| EF0775 | aggregation substance - chimeric | 4-10, 12-18, 24-29, 34-43, 50-65, 70-76, 111-117, 129-138, 152-159, 166-171, 184-195, 200-210, 224-236, 241-251, 274-283, 285-296, 313-319, 332-341, 348-355, 378-386, 410-416, 433-445, 475-482, 523-529, 531-540, 584-596, 626-633, 674-680, 682-688, 738-750, 780-787, 828-834, 836-842, 853-862, 882-887, 893-912 | H: 2 | 604-676 | 384, 436 |
| EF0779 | conserved domain protein | 15-38, 49-57, 60-99, 103-119, 124-194, 200-206, 215-249, 251-291, 307-313, 315-347, 369-378, 383-390, 393-400, 405-411, 423-435, 440-447, 454-460, 470-486, 490-503, 532-539, 542-549, 551-567, 579-592 | H: 2 | 509-583 | 385, 437 |
| EF1091 | hypothetical protein | 38-44, 47-88, 95-103, 157-172, 235-240, 250-260, 263-276, 294-300, 312-317, 331-337, 369-391, 412-419, 442-448, 453-463, 490-529, 537-555, 571-580, 600-617, 619-627, 642-648, 682-687, 693-700, 716-722, 738-748, 756-763, 779-789, 796-802, 820-828, 833-840, 846-853, 862-872, 880-887, 894-899, 924-937, 957-963, 1006-1012, 1043-1049, 1063-1069, 1076-1097 | F: 4 | 124-147 | 386, 438 |
| EF1323 | conserved hypothetical protein authentic point mutation | 4-28, 31-49, 60-71, 75-102, 104-114, 134-144, 160-184, 250-257, 277-285, 287-294, 330-338, 345-351, 367-374, 381-388, 393-399, 402-407, 420-426, 443-448, 458-464 | F: 8 | 411-436, 454-488 | 387, 439 |
| EF1355 | pyruvate dehydrogenase complex E2 | 20-27, 45-55, 57-64, 66-77, 98-106, 130-137, 155-165, 167-174, 176-187, 194-203, 208-223, 227-238, 245-251, 257-270, 273-278, 287-299, 330-345, 352-358, 363-385, 392-399, 410-417, 437-443, 467-484, 486-492, 495-500, 504-516, 526-536 | E: 2 | 219-270 | 388, 440 |
| EF1699 | transcriptional regulator MerR family | 11-22, 24-31, 46-63, 65-71, 73-88, 95-109, 174-181, 183-201, 204-212, 216-222, 228-233, 241-247 | H: 2 | 142-221 | 389, 441 |
| EF1744 | general stress protein | 8-28, 51-59, 67-84, 93-98, 140-152, 154-162, 183-188 | F: 3 | 91-125 | 390, 442 |
| EF1752 | conserved hypothetical protein | 10-22, 27-61 | F: 6 | 69-100 | 391, 443 |
| EF1753 | conserved hypothetical protein | 7-15, 18-26, 94-100, 126-131, 152-165, 219-228, 254-263, 274-292, 297-308, 333-340, 342-352, 354-371, 373-379, 403-410, 420-438, 450-456, 463-470, 489-495, 503-512 | G: 2 | 97-173 | 392, 444 |
| EF1791 | peptide ABC transporter peptide-binding protein | 4-21, 37-43, 49-65, 67-74, 76-90, 113-119, 131-141, 155-173, 175-189, 192-199, 207-221, 247-254, 266-276, 317-322, 337-343, 387-393, 408-428, 439-448, 451-460, 469-479, 482-487, 493-501, 517-523, 533-542 | F: 1 | 480-503 | 393, 445 |
| EF1800 | conserved hypothetical protein | 11-26, 40-46, 78-86, 93-103, 121-126, 132-138, 166-177, 183-196, 203-212, 214-221, 228-263, 304-311, 323-338, 345-351, 357-363, 379-393, 420-434, 442-448, 518-527, 547-553, 581-591, 602-609, 637-645, 665-674, 687-692, 701-708, 730-739, 796-802, 844-857, 882-888, 903-914, 944-950, 976-983, 1027-1033, 1049-1057, 1066-1072, 1085-1092, 1120-1127, 1137-1144, 1153-1158, 1165-1176, 1181-1187, 1221-1230, 1238-1244, 1269-1274 | E: 1 | 605-632 | 394, 446 |
| EF1818 | gelatinase | 6-47, 57-65, 83-95, 109-121, 138-147, 154-164, 167-177, 194-200, 202-212, 227-234, 240-253, 260-267, 283-291, 320-329, 340-347, 356-364, 412-422, 430-436, 441-459, 465-475, 478-486, 498-507 | F: 14 | 59-84 | 395, 447 |

TABLE 1c-continued

Immunogenic proteins identified with sera from endocarditis patients by bacterial surface display.

| E. faecalis antigenic protein | Putative function (by homology) | predicted immunogenic aa* | No. of selected clones per ORF and screen | Location of identified immunogenic region (aa) | Seq. ID (DNA, Prot.) |
|---|---|---|---|---|---|
| EF1850 | conserved hypothetical protein | 10-21, 58-83, 88-97, 120-126 | F: 1 | 21-51 | 396, 448 |
| EF1877 | conserved hypothetical protein | 5-39, 56-62, 76-88, 90-114, 138-162, 170-195, 202-221, 228-250, 264-270, 304-355, 374-387, 391-416, 462-471, 526-546, 554-561, 574-579, 639-645, 651-660, 674-682, 689-694 | E: 10 | 666-697 | 397, 449 |
| EF2174 | hypothetical protein | 6-30, 36-42, 143-157, 176-197, 202-209, 216-233, 241-246, 275-287, 292-299, 315-325, 343-350, 375-380, 397-403, 411-420, 422-434, 441-448, 467-474, 477-499, 555-568, 591-597, 601-609, 623-644, 667-688, 692-698, 703-718, 736-747, 757-766, 782-791, 795-801, 832-840, 859-865 | F: 119 | 226-269 | 398, 450 |
| EF2224 | LPXTG-motif cell wall anchor domain protein | 6-23, 43-51, 61-67, 73-82, 91-97, 123-130, 149-158, 164-175, 228-234, 240-246, 248-255, 262-272, 326-332, 340-347, 365-371, 377-388, 409-419, 425-431, 438-445, 449-457, 464-470, 496-507, 559-568, 575-581, 603-608, 617-623, 633-639, 648-654, 659-670, 695-701, 734-752, 806-814, 816-829, 861-868, 891-899, 904-909, 937-945, 947-960, 978-983, 992-999, 1022-1031, 1068-1076, 1078-1091, 1109-1114, 1123-1130, 1153-1162, 1199-1207, 1209-1222, 1254-1261, 1284-1293, 1330-1338, 1340-1353, 1371-1376, 1385-1392, 1415-1421, 1433-1438, 1460-1465, 1470-1492 | F: 2 | 1422-1458 | 399, 451 |
| EF2318 | Peptidase M23/M37 family V | 82-94, 111-118, 125-131, 206-212, 261-266, 310-320, 328-338, 345-351, 353-360, 414-420, 424-434, 440-447, 451-500, 506-516, 548-561, 566-572, 584-591, 601-622, 630-636, 650-659, 661-667, 674-699, 703-711, 717-729, 736-744, 752-759, 765-771, 813-822, 826-842, 852-868, 870-877, 881-895, 897-906, 913-922 | H: 5 | 602-671 | 400, 452 |
| EF2704 | A/G-specific adenine glycosylase | 12-18, 20-25, 43-54, 56-65, 73-79, 82-88, 99-111, 136-142, 153-169, 171-183, 195-223, 229-248, 255-260, 272-277, 281-292, 298-319, 322-329, 332-351, 363-379, 381-389 | F: 5 | 275-304 | 401, 453 |
| EF2713 | LPXTG-motif cell wall anchor domain protein | 4-9, 34-48, 65-77, 101-106, 111-131, 138-153, 186-191, 230-250 | H: 1 | 148-219 | 402, 454 |
| EF2802 | endolysin | 4-23, 30-35, 42-53, 67-76, 82-87, 101-108, 112-130, 132-138, 147-152, 161-183, 187-208, 218-225, 265-283, 295-303, 306-317, 322-334, 338-357, 360-368, 370-383, 387-398, 400-419, 421-430 | H: 2 | 104-182, 240-304 | 403, 455 |
| EF2813 | conserved hypothetical protein | 4-12, 63-69, 94-102, 146-164, 166-173, 175-181, 193-207, 263-281, 286-295, 301-306, 330-343, 369-378, 382-388, 414-420, 422-430, 438-454, 456-462, 472-531, 543-560, 581-591, 596-605, 614-623, 626-635, 656-662, 669-676, 683-690, 693-698, 705-711, 728-736, 752-764 | E: 4 | 69-102 | 404, 456 |
| EF2820 | hypothetical protein | 6-12, 43-53, 141-147, 164-179, 185-195, 197-206, 227-235, 237-271, 288-305, 308-317, 335-341, 351-357, 365-376, 386-395, 397-416, 422-447 | E: 1 | 11-35 | 405, 457 |
| EF3082 | iron compound ABC transporter substrate-binding protein | 16-24, 50-65, 73-84, 88-99, 114-124, 130-146, 181-187, 193-203, 214-220, 236-247, 250-258, 287-297 | F: 92 | 50-113 | 406, 458 |
| EF3256 | lipoprotein putative | 4-25, 50-55, 76-82, 117-123, 131-137, 139-148, 157-166, 239-245, 253-258, 266-275, 277-292, 300-306 | F: 5, G: 3 | 51-83, 93-161 | 407, 459 |
| EFA0021 | hypothetical protein | 6-22, 34-43, 51-86, 93-100, 110-116, 150-161, 164-171, 180-187, 197-218 | H: 2 | 168-237 | 408, 460 |
| EFA0044 | hypothetical protein | 4-27, 55-60, 74-82 | E: 6 | 10-46 | 409, 461 |
| EFA0052 | surface exclusion protein Sea1 | 6-19, 25-31, 43-49, 60-79, 88-100, 105-129, 148-161, 164-171, 187-193, 243-263, 316-322, 334-340, 369-378, 381-391, 398-404, 460-466, 474-483, 502-509, 511-517, 525-530, 558-567, 579-596, 622-627, 631-638, 641-651, 653-659, 674-680, 687-693, 710-716, 720-727, 743-753, 760-775, 788-795, 806-813, 821-828, 836-842, 847-860, 865-880 | H: 10 | 258-377 | 410, 462 |
| EFC0004 | TraC protein | 4-11, 25-64, 71-79, 88-94, 107-120, 123-132, 167-188, 231-237, 240-246, 261-267, 306-311, 330-342, 351-358, 389-395, 406-418, 429-434, 439-448, 483-501, 511-520 | G: 1 | 71-143 | 411, 463 |
| EFC0012 | LPXTG-motif cell wall anchor domain protein | 4-18, 22-27, 53-64, 94-100, 121-127, 133-139, 155-164, 177-182, 187-196, 206-218, 224-242, 248-253, 258-277 | H: 1 | 184-253 | 412, 464 |
| EFC0021 | conserved domain protein | 10-17, 56-67, 72-82, 94-99, 106-113, 166-173, 229-235, 243-283, 295-301, 313-321, 326-331, 342-348, 396-414, 423-435, 446-452, 454-462, 496-502, 511-534, 543-556, 563-570, 586-593, 616-626, 638-645, 653-662, 679-696, 731-737, 766-774, 776-782, 790-796, 810-817, 825-835, 837-846 | H: 5 | 540-615 | 413, 465 |

TABLE 1c-continued

Immunogenic proteins identified with sera from endocarditis patients by bacterial surface display.

| E. faecalis antigenic protein | Putative function (by homology) | predicted immunogenic aa* | No. of selected clones per ORF and screen | Location of identified immunogenic region (aa) | Seq. ID (DNA, Prot.) |
|---|---|---|---|---|---|
| EFC0053 | Transposase Mutator family | 13-24, 30-36, 73-81, 89-95, 109-115, 117-143, 161-173, 179-189, 226-244, 251-261, 275-281, 298-305, 307-315, 323-328, 364-374 | G: 6, H: 12 | 69-186, 264-354 | 414, 466 |
| ARFC0021.1 | hypothetical protein | 19-25 | D: 5 | 6-22 | 415, 467 |
| ARFC0021.2 | hypothetical protein | 6-39, 59-68 | D: 3 | 43-62 | 416, 468 |
| ARF0324 | hypothetical protein | 6-14, 22-32 | F: 2 | 1-27 | 417, 469 |
| ARF1627 | hypothetical protein | 4-41 | E: 127 | 28-40 | 418, 470 |
| ARF1650 | hypothetical protein | 8-14 | F: 5 | 4-19 | 419, 471 |
| CRF0097 | hypothetical protein | 4-10, 12-22, 30-35 | E: 78 | 6-33 | 420, 472 |
| CRF0257 | hypothetical protein | 4-16, 24-33 | F: 21 | 37-54 | 421, 473 |
| CRF0635 | hypothetical protein | none | E: 7 | 2-23 | 422, 474 |
| CRF1152 | hypothetical protein | 4-21, 27-33, 36-41 | E: 16 | 14-34 | 423, 475 |
| CRF1720 | hypothetical protein | 4-14, 24-30, 37-42, 57-78, 83-89, 94-103, 113-131 | E: 5 | 100-122 | 424, 476 |

TABLE 2

Epitope serology with human sera.

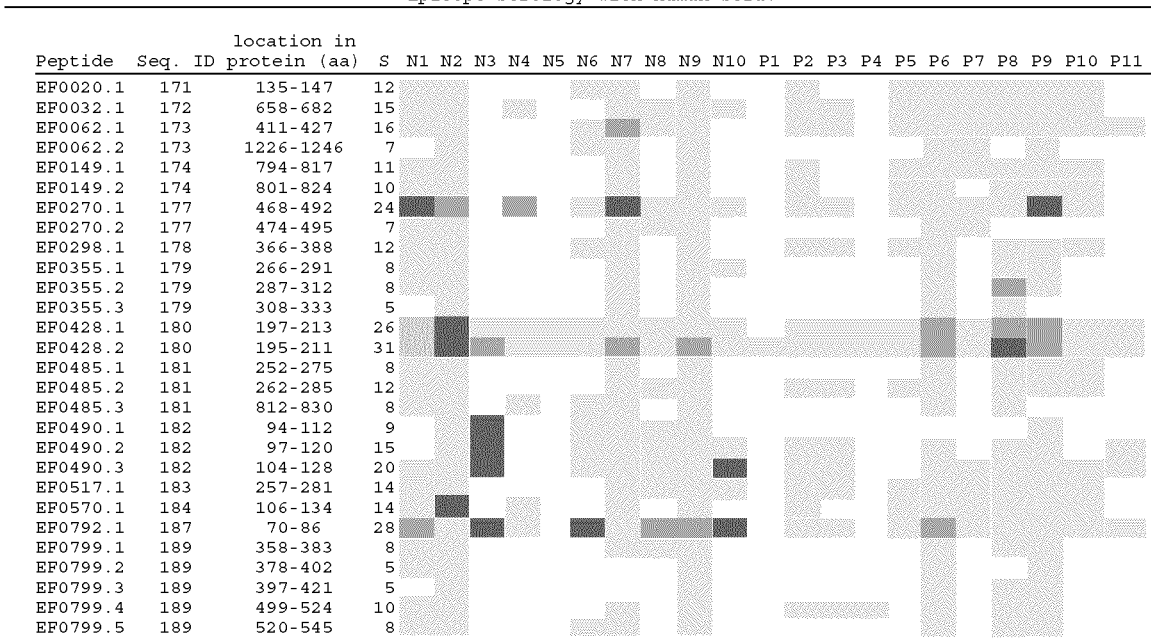

| Peptide | Seq. ID | location in protein (aa) | S |
|---|---|---|---|
| EF0020.1 | 171 | 135-147 | 12 |
| EF0032.1 | 172 | 658-682 | 15 |
| EF0062.1 | 173 | 411-427 | 16 |
| EF0062.2 | 173 | 1226-1246 | 7 |
| EF0149.1 | 174 | 794-817 | 11 |
| EF0149.2 | 174 | 801-824 | 10 |
| EF0270.1 | 177 | 468-492 | 24 |
| EF0270.2 | 177 | 474-495 | 7 |
| EF0298.1 | 178 | 366-388 | 12 |
| EF0355.1 | 179 | 266-291 | 8 |
| EF0355.2 | 179 | 287-312 | 8 |
| EF0355.3 | 179 | 308-333 | 5 |
| EF0428.1 | 180 | 197-213 | 26 |
| EF0428.2 | 180 | 195-211 | 31 |
| EF0485.1 | 181 | 252-275 | 8 |
| EF0485.2 | 181 | 262-285 | 12 |
| EF0485.3 | 181 | 812-830 | 8 |
| EF0490.1 | 182 | 94-112 | 9 |
| EF0490.2 | 182 | 97-120 | 15 |
| EF0490.3 | 182 | 104-128 | 20 |
| EF0517.1 | 183 | 257-281 | 14 |
| EF0570.1 | 184 | 106-134 | 14 |
| EF0792.1 | 187 | 70-86 | 28 |
| EF0799.1 | 189 | 358-383 | 8 |
| EF0799.2 | 189 | 378-402 | 5 |
| EF0799.3 | 189 | 397-421 | 5 |
| EF0799.4 | 189 | 499-524 | 10 |
| EF0799.5 | 189 | 520-545 | 8 |

TABLE 2-continued

| | | | |
|---|---|---|---|
| EF0799.6 | 189 | 541-566 | 9 |
| EF0799.7 | 189 | 622-646 | 4 |
| EF0799.8 | 189 | 641-665 | 7 |
| EF0799.9 | 189 | 660-684 | 8 |
| EF0922.1 | 192 | 248-260 | 15 |
| EF1012.1 | 194 | 15-34 | 4 |
| EF1026.1 | 195 | 112-129 | 10 |
| EF1032.1 | 196 | 333-358 | 12 |
| EF1032.2 | 196 | 353-378 | 3 |
| EF1060.1 | 197 | 316-343 | 7 |
| EF1060.2 | 197 | 339-366 | 8 |
| EF1060.3 | 197 | 362-389 | 16 |
| EF1093.1 | 198 | 98-123 | 11 |
| EF1093.2 | 198 | 104-126 | 7 |
| EF1277.1 | 201 | 20-43 | 15 |
| EF1277.2 | 201 | 23-48 | 15 |
| EF1386.1 | 203 | 124-145 | 6 |
| EF1404.1 | 204 | 717-738 | 4 |
| EF1561.1 | 205 | 37-56 | 4 |
| EF1584.1 | 206 | 118-134 | 17 |
| EF1601.1 | 208 | 500-522 | 5 |
| EF1692.1 | 211 | 32-47 | 16 |
| EF1741.1 | 212 | 25-51 | 10 |
| EF1741.2 | 212 | 47-73 | 7 |
| EF1741.3 | 212 | 69-95 | 11 |
| EF1823.1 | 215 | 503-529 | 11 |
| EF1978.1 | 216 | 112-128 | 14 |
| EF2052.1 | 218 | 181-199 | 8 |
| EF2074.1 | 219 | 109-121 | 17 |
| EF2266.1 | 220 | 150-163 | 12 |
| EF2305.1 | 221 | 77-97 | 10 |
| EF2307.1 | 223 | 564-586 | 4 |
| EF2326.1 | 224 | 75-94 | 4 |
| EF2378.1 | 225 | 776-798 | 4 |
| EF2378.2 | 225 | 784-808 | 11 |
| EF2378.3 | 225 | 794-815 | 20 |
| EF2476.1 | 226 | 196-212 | 14 |
| EF2556.1 | 226 | 78-100 | 3 |
| EF2556.2 | 226 | 85-107 | 4 |
| EF2581.1 | 230 | 536-553 | 14 |
| EF2682.1 | 232 | 102-125 | 7 |
| EF2703.1 | 233 | 178-198 | 24 |
| EF2858.1 | 238 | 612-626 | 13 |
| EF3023.1 | 245 | 171-187 | 14 |
| EF3041.1 | 246 | 296-320 | 1 |
| EF3041.2 | 246 | 315-339 | 4 |
| EF3041.3 | 246 | 334-358 | 3 |
| EF3041.4 | 246 | 353-377 | 7 |
| EF3051.1 | 247 | 47-71 | 16 |
| EF3060.1 | 248 | 1-25 | 28 |
| EF3060.2 | 248 | 20-45 | 5 |
| EF3060.3 | 248 | 40-64 | 1 |
| EF3073.1 | 249 | 146-161 | 16 |
| EF3096.1 | 251 | 910-935 | 15 |
| EF3096.2 | 251 | 1007-1030 | 7 |
| EF3125.1 | 252 | 212-226 | 14 |
| EF3177.1 | 253 | 126-152 | 19 |
| EF3177.2 | 253 | 148-173 | 7 |
| EF3177.3 | 253 | 169-195 | 7 |
| EF3207.1 | 255 | 288-310 | 2 |
| EF3207.2 | 255 | 293-316 | 16 |
| EF3290.1 | 257 | 293-312 | 3 |
| EF3295.1 | 258 | 154-170 | 19 |
| EF3319.1 | 259 | 72-95 | 7 |
| EF3319.2 | 259 | 90-112 | 7 |
| EF3319.3 | 259 | 97-121 | 15 |
| EFA0042.1 | 262 | 135-150 | 31 |
| EFA0042.2 | 262 | 146-163 | 23 |
| EFA0047.1 | 263 | 799-827 | 10 |
| EFC0034.1 | 266 | 23-43 | 16 |
| EFC0034.2 | 266 | 33-53 | 16 |
| ARFC0021.1 | 268 | 44-62 | 6 |
| ARF0679.1 | 276 | 6-22 | 36 |
| ARF2052.1 | 280 | 37-54 | 29 |
| ARF2125.1 | 281 | 40-54 | 17 |
| ARF2307.1 | 282 | 7-21 | 15 |

REFERENCES

Altschul, S., et al. (1990). *Journal of Molecular Biology* 215: 403-10.
Bennett, D., et al. (1995). *J Mol Recognit* 8: 52-8.
Burnie, J., et al. (1998). *J Antimicrob Chemother* 41: 319-22.
Cetinkaya, Y., et al. (2000). *Clin Microbiol Rev* 13: 686-707.
Clackson, T., et al. (1991). *Nature* 352: 624-8.
Devereux, J., et al. (1984). *Nucleic acids research* 12: 387-95.
Doherty, E., et al. (2001). *Annu Rev Biophys Biomol Struct* 30: 457-475.
Eisenbraun, M., et al. (1993). *DNA Cell Biol* 12: 791-7.
Etz, H., et al. (2001). *J Bacteriol* 183: 6924-35.
Ferretti, J., et al. (1986). *J Bacteriol* 167: 631-8.
French, G. (1998). *Clin Infect Dis* 27: S75-83.
Gaglani, M., et al. (1997). *J Clin Immunol* 17: 478-84.
Ganz, T. (1999). *Science* 286: 420-421.
Georgiou, G. (1997). *Nature Biotechnology* 15: 29-34.
Gold, H. (2001). *Clin Infect Dis* 33: 210-9.
Haas, W., et al. (2002). *Nature* 415: 84-7.
Hancock, L. E., et al. (2000) pp 251-258. In Fischetti, V. A., et al. (ed.), Gram-positive pathogens. AMS Press.
Hashemzadeh-Bonehi, L., et al. (1998). *Mol Microbiol* 30: 676-678.
Hemmer, B., et al. (1999). *Nat Med* 5: 1375-82.
Hoe, N., et al. (2001). *J Infect Dis* 183: 633-9.
Huebner, J., et al. (2000). *Infect Immun* 68: 4631-6.
Jett, B., et al. (1994). *Clin Microbiol Rev* 7: 462-78.
Johanson, K., et al. (1995). *J Biol Chem* 270: 9459-71.
Jones, P., et al. (1986). *Nature* 321: 522-5.
Kajava, A., et al. (2000). *J Bacteriol* 182: 2163-9.
Kohler, G., et al. (1975). *Nature* 256: 495-7.
Lewin, A., et al. (2001). *Trends Mol Med* 7: 221-8.
Lowe, A., et al. (1995). *Infect Immun* 63: 703-6.
Marks, J., et al. (1992). *Biotechnology (NY)* 10: 779-83.
McCafferty, J., et al. (1990). *Nature* 348: 552-4.
McCormick, J., et al. (2001). *Infect Immun* 69: 3305-14.
Murray, B. (1990). *Clin Microbiol Rev* 3: 46-65.
Navarre, W., et al. (1999). *Microbiol Mol Biol Rev* 63: 174-229.
Noble, W., et al. (1992). *FEMS Microbiol Lett* 72: 195-8.
Okano, H., et al. (1991). *J Neurochem* 56: 560-7.
Oligodeoxynucleotides as Antisense Inhibitors of Gene Expression; CRC Press, Boca Ration, Fla. (1988) for a description of these molecules.
Paulsen, I., et al. (2003). *Science* 299: 2071-4.
Poyart, C., et al. (1997). *Antimicrob Agents Chemother* 41: 24-9.
Rammensee, H., et al. (1999). *Immunogenetics* 50: 213-9.
Rice, L. (2001). *Emerg Infect Dis* 7: 183-7.
Richards, M., et al. (2000). *Infect Control Hosp Epidemiol* 21: 510-5.
Rosenshine, I., et al. (1992). *Infect Immun* 60: 2211-7.
Seeger, C., et al. (1984). *Proc Natl Acad Sci USA* 81: 5849-52.
Shankar, V., et al. (1999). *Infect Immun* 67: 193-200.
Skerra, A. (1994). *Gene* 151: 131-5.
Sussmuth, S., et al. (2000). *Infect Immun* 68: 4900-6.
Tang, D., et al. (1992). *Nature* 356: 152-4.
Tempest, P., et al. (1991). *Biotechnology (NY)* 9: 266-71.
Tourdot, S., et al. (2000). *Eur J Immunol* 30: 3411-21.
Whitnack, E., et al. (1985). *J Exp Med* 162: 1983-97.
Whiley, J., et al. (1987). Current Protocols in Molecular Biology.
Xu, Y., et al. (1997). *Infect Immun* 65: 4207-15.

SEQUENCE LISTING (480 sequences)

SEQ ID NO: 1 - DNA, 990 bp, Enterococcus faecalis
atggtaggaattatcctagcaagtcacggtgaatttgctgaagggatcttgcaatctggtgcaatgatctttggcgaacaagaaaatgtaaaagcagttacgttaatgcctagcgaaggtcccgatgatgtaaaagcaaaaatgcaagaagccattgcatcgtttgacaatcaagacgaagtactatttttagttgacctatggggaggaacaccatttaaccaagcgaactcattgttagaagatcataaagacaaatgggcaatcgttgcaggtatgaacttaccaatggttattgaagcatatgcttctcgtttctctatggaatcagcacaagaaattgcgacacacattcttgaaacagcaaaagatggtgtcaaagttaaaccagaagagttacaaccagcagaagcaccaaaagctgctgcgacagaagatgcacagccaaaaggttcgttaccaccaggtacagttgttggcgatggcaaaattaaatttgtgctagcacgtattgattcacgtttattacatggtcaagtagcaacagcttggacaaaagcaacacaaccaaacagaattattgttgtttctgatgccgttgcaaaagatgacttacgtaagaaattaatcgaacaagcagctcctccaggagtaaaagccaatgttattccaatcagtaaaatgattgaagtagcgaaagatccacgttttggcaatacaaaagcattattattatttgaaaatcctgaagacgtcttaaaagtggttgaaggcggcgtagaaatcccagaagtaaacgttggttcaatggctcactctgttggaaaagtcgttgtaagcaaagtattatcaatgggtcaagaagacgttgatacgtttgatgaattaaaagccaaaggcatcaaatttgatgtgcgtaaagtgccaaatgattcaaaagcgaatatggacgaaattttgaaaaaagcaaaaaatgagttagcaaacgcg

SEQ ID NO: 2 - DNA, 2613 bp, Enterococcus faecalis
atgaaaaataaaagtaggcagtttttaaaaaacaactggccttatatgttagccagtttcttcattccatttttaattatggcaattatctatttgagtattgggatttatccaggaagtagtcgcagtgttttagccagcgatgccttttctcaattttcaaattttcacgcaagctttaacaatgttcttcatggaaaacaaagtcttttctatacgtggaatgcttctttgggactaaactacttgtccttaatttcctattatcttggtggcttatttacgccgctcgtctttttctttaacaatcaaaacatgcctgatgcgctctatttcctaacgttgttgaaaattgggagtgctggcttgagtttttggttcttggcaaaacaaacctttaagattcctaaatggtcccatgtgactttaagtgtgtcttatgcgctaatgtccttcattgtggcccattcagaattaattatgtggctggatgcctttatttatctgccactcgtaattttaggaattcatcgtttaatggaccaacgaaaaccgacattattgtttgtcagttatttcttgcttttcattacaaattattattttggctttatgattgggttgttttccttcctgtactattttgcacgaacgtttacagactggcaacgatataaatctcgaatcgttgcgtattttactacttctcttttagctggtggagcatccatgattatggtcttacctgctgtcttagatttacgaaccaatggtgaaactctttctgaaattacaacctttaaaacagaagcgactgcctttttagatattattatgaaaaatatgattggcgtttacgatacaaccaaatatgggtccattccttttatttacattgggttgttgcctttgattttttgtctcttctatttcgttacgaaagaagttccattgaaaaacaaactactttttggcagtttgtttgtcctattgattgctagcttttacatcacgcccttaaatttattctggcacggtatgcatgcgccgaacatgtttcttttccgctatagtttcctcttttcattcttagttattttgcttgcaggttatggttgggagaaatttgaaaaggatgatctcggtgtcttaagcggcttgattttgattcttttagcaatttttgctcttgcaatgggcacaaaaggtgctactagttatacgtatgtgactttaacctctttcgtattaacggcaacttttttactattatactttttcgggattgctttttatcaattgaaaaaagcgcctatgcaatacttagtgattttgttattgctgctcgtttctggtgaagcaatcattaacacacgggcgatggtcactggtattttagatgattggaactacgcatcacgcagcttgtattctgagccttatcctgacttaaaaaatctagtcgatcaaacaaaaaaagaaaatgataccttttaccgcttggaaaatttaaatggtgtttcggccaatgacggcattaactatggctacagtggcattagcatgttttcttccgtacggaaccgacattcttcaacatacctaaacgccttaggtttccgctcacgaggcacgaatttaaatattcgttaccaaaataataccttgttaatggatgctttgatgggcattaaatacaatattgctgaaaacaatccaatgaaattcggctttgagcgacaagctgctgctggtaaatatcagctttatcgtaacgaaaatgctttgccgttaggatttttagcagacaaagagatttacaatgtccggcaacctctcaatgataatttaggtagtcaaacaaatttactaaatgctttagccaatactaatgaacggtattttaccttttatcaaccaacgatgacgcttcaaaataacgtgacaattacgcaaaatacagctggcgtaacttttacggagaaacaacataacgtagccaaagagatttcttatacagtcaatgtgcccgccaatacgcaagcttatttgagtttattcccaacggattttgctcaattggaaagttccactgcgacggtcaccgtgaacggctcaagtcagcaatcacaaattggcattactggccaatattataacttaggttactatcccaaagatacaaccgttaacttcaaagtaagtttttatggaaccaaagcagtaagttttgttcagccgcaagtggttggcttaaataccaatgcatttgaaaaagccatttccgccgtgcaagaaaaaggcgttgatttaacaactggcaaacgctctgcttcaggtacctttaccgccgacaaagatcaagtactcgtcactacaattccttatgacaaaggttggcgtgtcaaaattgatggcaaaaaagttaccccaaaagcctttaaagatgcctttctaagcgttcctgtcagcgctggaacccatactattcagttctcttatttaccagaaggattgattcctggcatcgtgttattcgttctatgtactggtggtttcgttgcctacgtaaccttgattcctgctagacgaaaccgtaaaaaagaagacaaa

SEQ ID NO: 3 - DNA, 3939 bp, Enterococcus faecalis
gtgaaaaagttgagctttaaaaaagtgaagtggggcatgcattttttaatggctgttgcgttgatagcgccaagtgttactagtacggcatatgcagtagaaacaacgagtcaacaaagttcagaagcagtaacaagtaccaccgattcaagtagaaaacaagaaccagtcattacacaggaaacaacagacatcaaacaagaagcaccaaatcaggctacgagtgacagtgtcaagcagtcacaagaaaccacagcaccaacagagacgacgaatttagaaacgtcaatcgctgaaaaagaagaaacgagcacgccgcaaaaaataacaattttaggtacgtcagatgttcatggtcaattatggaattggtcttatgaagatgataaagaactaccagttggtttgtcccaagtaagtacagtcgttaaccaagtccgggcacaaaacccagcaggcaccgttttaattgataatggcgacaatattcaaggcactattttaacagatgacttgtataataaagcgcctttagtgaatgaaaagacccatccaatgatcaccgccatgaatgtgatgaagtatgatgcaatggttttgggaaatcatgagtttaattttggtttaccgttaatcaaaaaaattcaacaagaagccacttttccaatcttgtctgcgaatacctacaataaggaagatggtcttcgttttgttgaagggactaccacgaaggaacttgattttaatcaagatgggcagccagatttaaaagttgggattatcggcttaacaattccgcacattcctttgtgggatggccctcgtgttacttcgcttaattttttacctttgaaagaagaagcagaaaaagcagttactgagttgaaagctaacgatcaggctgacattattgttgcctcgattcatgcgggacaacaaaatagtgatccggctgccagtgccgaccaagtaattgaaaatgtcgcggggattgatgcgtatattctgggtcatgaccacctttcttttaccaagcaaggagcagcgccgaatggaaaaactgtaccggtagggggaccgaaagatacggggacagaagttgtcaaaattgatctttcagttgctaaaaatgccgataagtgggaagtgcaagaaggtacagcaacgattgtaccaacaacgaatgttccagcagatgaagcagttaaggcagcgacaaaagaataccatgaaaaaacgcgagcgtttattcaggaggagatcggcacagcaacagctgattttttaccaaaacaagaaattaaaggaattcccgaagcacaattacaaccaacagcgatgatttctttaattaataacgttcaaaaagaagtaacgggcgcacaattaagtgcggcagcgctgtttaaatacgacagtaaattacctgcggggaagatttcctatgccacgatttttgatatctacaaatacccgaataccttagtgagtgttcccattaacggtgaaaacttactgaagtatttagaaaaacaaggggcgtactataaccaaacacagccagatgatttgaccattagttttaatccaaacattcgtgtatataactatgacatgatttctggagtggactacaagattgacatttcaaaaccagtgggtgaacgaattgtagatgcgaaaattgacggccaaccgctggatcctgccaaagaatatacgattgctatgaataattatcgttacggcggtttagctagccaagggattcaagtaggggaacctattaaaaattctgatccagaaaccttacgaggaatgattgttgattatattaagaaaaaaggaactcttgatccagaacaagaaatcgaacgaaattggtcaattattgggacaaattttgatgaaaaatggcgtgccaaagcaatcgaattagtgaatgacggcactcttcaaattccgacttctcctgatggacgtacaccaaacgccgccgctattacgaaacaagatgtccgtaatgcgggctttgatttagataatgcatataccattatgcacacaaatgacgttcatggccgactagaagcagggaaaggcgaattaggtatggcgcgtctaaaaacctttaaagaccaagaaaacccaaccttgatggtggatgcaggggatgttttccaaggattaccaatctccaatttctccaaaggcgcggatatggccaaagcaatgaatgaagttggttatgatgccatggcggtgggaaatcacgagtttgattttggtttagagattgcactaggttataaagaccaactgaattttccgattttatctagtaatacgtattacaaagatggcagtggacgggtttttgatccgtatacaatcgtagaaaaatccgggaaaaagtttgccattgtaggtgtgacgaccccagaaacagcaacgaaaacacacccgaaaaacgtagagaaggtgacatttaaagacccgattccagaagtagaagcagtgattaaggaaattaaagagaagtacgcggatattcaagctttcgtggttactgggcatttaggcgtagatgaaacgacgccgcatatctggcgtggtgatacgctagcagaaacccttagtcaaacatatcctgagttagatatcactgtgattgatggacattcgcatacagccgtcgaaagtggcaaacgttatggcaaagtgatctatgctcaaacaggtaattatttaaataatgttgggatcgtcacagcaccagagagtgaaccaactaagaaaacaacaaaattgatttcagcagcagagctgctagaattgccagaaaacccggcagttaaagccatcgttgatgaagcacgtacgaattttaacgctgaaaatgaaaaagtaattgtcgattatattccattcacattggatggacaacgagaaaatgtgcgcacacgagagaccaacttagggaatttgattggtgatgcgattatgtcatatggccaagacgcgtttagccaacctgctgattttgcagtaactaatggtggcggcattcgcgctgatattaaacaagggccaattaaagttggggatgtcattgctgtgttaccttttggcaatagcattgcgcaaattcaagtaaccggcgcccaagttaaagaaatgtttgaaatgtctgttcgttcgattccacaaaaagatgagaatggcacaattttactagatgatgctggccaaccaaaacttggcgcaaatggtggtttcctacatgtttcaagctccattcgtatccactatgattccacaaaaccaggtactcgcttggctagtgacgaaggcaatgaaacaggacaaacgattgtcggtagtcgcgtattaggaatagaaattaaaaatcggcaaacacaaaagtttgaaccattggatgagaagaaacaataccggatggctaccaatgatttcttagctgctggtggtgatggttacgatatgctaggtggtgaacgagaagaagggatttcactagattctgtcttaattgaatacttgaaaagtgcaaccagcttgcggttgtatcgtgcagcaacgacgattgatttagcacaatataaagaaccattcccaggcgaacgaattgtttctatttcggaagaagcttacaaagagttaatcggtggaggagagacgccaaaaccagatccaaaaccagacccgaaaccaacaccagaaacaccagtagcaaccaataaacaaaaccaagcgggagcaagacagagcaatccatccgtaacagagaagaaaaagtatggcggctttttacctaaaacgggtacagaaacagaaacgcttgcattatatggtttactgttcgttggactttcttcttctggctggtatatttataaacgacgtaacaaagctagt

SEQ ID NO: 4 - DNA, 3915 bp, Enterococcus faecalis
atgaatcaacagactgaagtaaaaaaacgttttaaaatgtataaggcaaagaaacactggattgtagcccctattctttttttaggtgtattaggagctgtaggattagctacagataatgtacaagccgcggaattagatacgcaaccaggaacaacgacggtgcaacccgataatcccaacccgcagtcacgaaatgaaacacttaaaacggcagtatctgaagaagcagcattacaaaaagacactacttctcaaccaaccacagcagaagaagtagtgccgaaaggaattgctgctgaacaaagttcagctacctcaaatgataccacaaacgtccaacaaccaacagcagaagcagaaaaatcagcacaagaacaaccagtagtcagccctgaaacaaccattgaacctctagggcagccaacagaagttgcaccagcagaaaatgacgctaataaatcaacgtcaattcctaaagaatttgaaacaccagacgttgacaaagcagttgatgaagcgaaaaaagatccaaacattaccgtcgtggaaaaaccaactgaagacttaggaaatgtttcttctaaagatttagctgcaaaagaaaaagaagtagaccaactacaaaaagaacaagcccaaaagattgcccaacaagcagctgaattaaaagccaaaaatgaaaaaattgccaaagaaaatgcagaaattgcggcaaaaaataaagcggaaaaagagcgctacgaaaaagaagtggcggaatacaacaaacacaaaaatgacaaaggctatgtgaatgaagcaatcagcaaagacttagtttttgattcaagcattgtgactaaggatactaaaatagacaagattacaggtggcaagtttattaaagcttccgattttaacaaagtaaaccaaggacaatccaaagatatttttacaaaattaagtaaggatatgaatggaaaagcaacaggcaacttccaaagctcaaaagtggctgctgttgaatttggccctaaaggaggatacgcggttcttttagaaaaaaacaaaccggtcaatgtcacgtatacaggattaaatgctagttatttagaccgaaaaatcacaaaagcagagttcatttatgaacttcaatctgcaccaagtcaaagcggcaccttaaatgcagtattttcgaatgatcctattattacagcatttgttggtactaaaaatgccaatgggaaggacgtaaaagttcgcttaaccattaaattatatgatgctaatggcaaagaagttttaccagataaagaccatgcctttgcctatgcgttatcgtcattaaactctagtctaggaacaaattatagtgtagaacatgcggaatttgtttcagactttggctcaaaaaatgagttcaagtatattaatggttcctacgtaaagaaacaagcggatgggaaattctactcaaccgaagaccttgattatgggacaggtccttcaggactaaaaaatagtgattgggacgctgtaggtcataaaaatgcgtactatggttctggtgtaggtctagctagagagggtggacgtatttctttctcttttggtatgacaaccaaaggaaaagtcaacctatctggtgcgcaatggtttgcctttagtaccaatttaaatgcgaaatcaattagaccataccaaaagaaagggaatccaaaagaaccagaaaaagcaacaattgaattcaatcgatacaaagccaatgtcgttcctgttcttgtgccgaataaagaagtcactgatggtcagaaaaatatcaatgatttaaatgtgaaacgaggcgattctttacaatacattgtgacaggggatacgacagaacttgccaaagtagatccgaaaacagtgacaaaacaagggattcgggatacctttgatgcagaaaaagtgacgattgatttatccaaagtgaaggtttatcaagcagatgcaagtctaaacgagaaagacttaaaagctgttgctgcagcgattaattcaggaaaagctatagacgtgactgcttcttatgttcttaatttagatcaaaacaccgtcacagcaatgatgaaaaccaacgcagacggttccgttgttttagcaatggggtataaatatttacttgtcttgccgtttgtagtgaaaaatgtagaaggcgattttgaaaatacagctgttcagctgacaaatgatggcgaaacggtaacaaatacagtgattaaccatgtgccggttagtaatccttccaaagatgtaaaagcagataaaaacggtacagttggcagtgtttctctacatgataaagatattccgttacaaacaaaaatttattatgaagtgaaatcttccgaacgtccagctaactatggcggaattaccgaagaatggggcatgaatgatgtcttggacacgacccatgatcgtttcacaggtaaatggcacgctattacaaactatgaccttaaagtaggggacaaaacgttaaaagcaggaacagatatttctgcctacattcttttagaaaacaaagacaataaagacttgacgtttacaatgaatcaagcattattagcagcgttaaatgaaggaagcaataaagtaggcaaacaagcttggtctgtatatctggaagtcgaacggatcaaaacaggtgacgtagaaaatacgcaaacagaaaactacaacaaagaacttgttcgttctaatacggtggtgacgcatacacctgatgatccaaaaccaaccaaagccgttcacaacaagaaaggggaagatattaaccatggaaaagttgctcgtggtgatgttctttcttatgaaatgacgtgggacttaaaagggtacgataaagactttgcttttgacacagtcgatcttgcgacaggagtttctttcttcgatgattacgacgaaacgaaagtgacaccaatcaaagacttacttcgtgtcaaagattctaaaggggcagacattacgaaccagttcacgatctcttgggacgatgccaaaggcacggtgacaatctctgccaaagacccacaagcctttattctagcgtatggtgggcaagaattgcgtgtaacgctccctacaaaagtcaaagccaatgtttctggtgatgtttataattcagcggaacaaaatacatttggtcaacgaattaaaacaaataccgttgtcaaccatattccaaaagtgaaccctaaaaaagacgtggttattaaagttggtgacaaacaaagtcaaaatggcgccacaatcaaattaggggagaaattcttctatgaatttacaagtagtgacattcctgcagaatacgctggtgttgtggaagaatggtcgattagcgataaactagacgtaaaacatgacaaatttagtggccaatggtctgtgtttgccaattctaattttgttttagcagacggaaccaaagtgaataaaggggacgacatttcgaaactattcacgatgacctttgaacaaggggtagttaaaatcacggccagtcaagcgtttttggatgcgatgaatctaaaagaaaacaaacacgttgcgcactcatggaaagcgttcattggtgtagaacgaattgcggcaggagacgtttacaacacaatcgaagaatctttcaacaatgagaagattaaaactaatacggtagtgacacatacgccagaaaaaccacaaacaccaccagaaaaaacagtgattgtaccaccaacaccaaaaacaccacaagcaccagtagagccattagtggtagaaaaagcaagtgtggcacccgaactacctcatacaggtgaaaaagaaaacaccctattatctgtactaggtgccggaatgctagttggtctggcttggtttggtttgaaaaaacgtgaagtgaaa

SEQ ID NO: 5 - DNA, 573 bp, Enterococcus faecalis
atgaaacgaattggttatgcacgcacaactattattgaagacgatttaaaaaatcaactaaccactctccaatcgtttggttgtgatgatattttccaagagacatttgatcctcaagcggagatcagtgtcttagacgaagtcgaaaaacttctttctgctggggatacacttattgtttgtaaattgcaccatttaggtaaaacaacccgccaattaacagactttatgaaaatgttaaaggaaaaacaagttgattttgtcagcatttcagaaggaattgatactcaccttccaacaggtgaagcctatttccaattaatggagagcttatctgcgatggaatgtgcactaattaaagaacgaacactcgtcgggctccacaaagctcgtgaaaacggaaaagtaggtggacgtccaaaaatcgatggacgcaccgtccgcaaaatccgtgcattatattatgaaaacaaagaaacaatccaatttatttctaataaatgcggcgtttcggtgggcacttgttataagtacatcaatttacctgagacagatgtcgagcggctgtattcc

SEQ ID NO: 6 - DNA, 1488 bp, Enterococcus faecalis
atgagtaaaaaagaaataaatcaagtagttgccagtagctatcaattgtatattaatggagagtggacaacaggtagtggtaacaaaatgattgctagttacaatcctagtaatggcgaaaaattagcagaatttgtagatgccacaaatgcagatgtggatcgagctgtagaagcagcccaagaagcgtttcagacatggaaagatgttgacgttgtaacaagaagcaatcttttgttgaaaattgctgatttgattgaagaaaatcaagaacatttggctatggtggagactttagataatggaaaaccgcttcgggaaacgcaatcgattgatgtccctgccagtgcagaccattttcggtattttgctagtgtgattcgtggagaagaaggatctgtcaaagaatttgataaggatacgttatccattgttgtgaaagaacccatcggtgttgtgggtcaaattattccgtggaatttccccttattaatgggtgcttggaaattagcaccagcgttggcagcaggtaacacggttgtgattcatccgtcctcgagcacatcattaagtctgttggaattgtttaaaatttttgatcaagtcttgccgaaaggagtagtgaatttaatcaccggtcgtggttctgattcaggaaattatatgttggcacatccagggtttgataagctagcttttacaggctcaacagaggtggggtacactgtcgctaaagcggcggccgaccgcctaattccagccactttagaacttggcggaaaatcagccaacattatttttgaagatgccaattgggaacgtgcattagaaggcgtgcagttagggattttattcaatcaagggcaagtttgttgtgctgggtctcgtgtgttcgttcagtcaggtatttatgatcaatttgtagaagctttaaaggaaaagtttgaacaagtgaacgttggtttcccgtgggaaaaagatgttgaaatgggcgctcagatcaatgagcatcaattggaagaaattttaaaatatgtcgaaattggtgtgaaggaaggagctacgctgattactggtgggcaacgtttaacagaaaatgggctagacaagggggcgtttttagcacctacgttattagcgaatggtacgaatgcaatgtgtgtggcccaagaagaaatctttggtcctgttgcaacagtgattaaatttgaaacggaagaagaagtcattcgtttagctaatgattctgaatatggtctaggtggtgccgtcttttctcaagatatcaatgtggcattacgggttgctcgtggtgtacggacaggtcgaatgtgggtcaacacatacaatcaattgcctgcgggcgcgccatttggcggttataaaaaatcaggaattggtcgagaaacgcataaatcaatgctagatgcttatacgcaaatgaaaaatatttacattgtgacaaaagaagaagcagatggactgtat

SEQ ID NO: 7 - DNA, 1896 bp, Enterococcus faecalis
atgggaaaatatcatgaactagcagaaaaaattgtaaaaaatgtcggtgggcaagagaatattaatagtttgacacattgtatcacacgtcttcgcttcaaattaaaagatgagagtcaagcgaatgatgatgtcttaaaaaatatggacggtgtggtaactgttatgaaaagcggtggacaataccaagtcgttattgggaaccatgttccagccgtttacgaagaagtagttagtattgcaggcttgtcaggagaacgtgaagaagaagcttccagtgggaatttatttgatcgcttaatagatattttaagtggttgtttccaaccctttttaggggcgttagcagcggctgggatggtcaaagggttaaatgccttattggttttcttaaagctctatacggctacgtcagggacttataccatgttaaatgggattggcgatgcaattttctactttatgccagttattttaggttatacagcagctaaaaaattccggttgcatccaatggtagggatcgtgattggcgcagctttatgttacccaacgattcaaggaagtgcattacaaacggcctttgaaacaacagcgggtgccggagccgcagcaccgtataatttattcggtttacctgcctataatacatttatggggattccttgggtcggtgcgaactatacaagtagtgtcgtaccaatcatcttcattattgcttttgcggcacaagttcaaaaagtgtttaaacgtattattccagaagttgttcaaacgttcttagtaccgtttttcgtcttgttgattgccttaccaattggtttcttagtaattgggccaatcgttagcatgctaacagatttattaagcgctggctttacagcattaatgagtttctcaccagctttgtatggtttgattcttggtttcttctggcaagtcttagttatttttggtttacattggagcgttgtgccattagctattatgcaagtgacacaagaaggttcaagccaagtattaacgggatcatttgcagctagttttgcgcaaacagcggttgttttagcgatgttcttcaaattgaaagataaaaagttaaaagctttgtgtccgccagcaattatctctggtatttttggtgtaacagagccagcaatttatggaatcactttaccaaaaaaatggccatttatttattcaatgattggtggcgctgtcggtggtttatatttgatgatcaacaatgtgacagcttatacaatgggtggtttaggaatttttggtgtgctaaactttatcaatggtgatgatgcaagtgggatgatccagtcctttattgcaattgccattgcagcggtcgttggttttggtctaacattcttcttctggaaagacaatacagttgaggaagaagaagtgattattgataaaacaacgattaaaaaagaaaatattacaagtccagtcaaaggacgagtgttatctttaaaaaatgcagaggatcctgcttttgcaaatggagcattaggaaatggggtcgtgattgaaccaacggaaggtaaagtggttgcaccctttgatggaacgattgtcacactattcccaacaaaacatgcattaggtttgatttcagataacggcacagaattattgattcatattgggattgatacagttcaattagaaggcgaaggctttgaagcttttgtaaaacaaggtgaccgcgtgaaaaaaggtcaaacattagtaacctttgatttagaaggaattaaaaaagctgggtttagtacacaaattccaatcgttgtgacgaatacagcggattatttagatattttggaagtcggcagtaatgaagtttcaacaagtgatgatttgctgaccgctttaata

SEQ ID NO: 8 - DNA, 2484 bp, Enterococcus faecalis
atggaaagtaaaacgtttgatattgaagggatgagctgtgcttcctgtgcccaaacgattgaaaaggctacggcgaagttacctgggatggcaaaggcaagtgtcaatttagctacggaaaaattaagtgtcacgtatgatcagacggaagtcacagaagaagaaattaaggaagctgtgtcagatgctggctacaaggcgattagcccagcccagcaacgaacgtttgcgattgaaggaatgagttgtgcttcctgtgcccaaacgattgaaaaagctgtgaaccaattatctggtgttcaacaagcgattgttaatttagccacggaaaaactggtggttagttatgacgaccatcaagtaacgagtgctgaaattatcaaagcagttacggatgcaggttatcaagcgacagaagaagtcgctgcaggtgcaacagcggaccaagatcgtgaaaagaaacaaaaacatattgctgagatgtggcaacgtttttggatctcagcggtgtttacagtgccccttctttatattgcgatgggacatatggtaggcttaccattgccggattttttgaatccaatgacacatgcgatgacctttgcaatggttcaattgattttgactttacccgttctatatgtcggcagagaatttttcacagttggttttaaagcattgtttaaagggcatccgaatatgttttctttggtggctttaggaaccagcgctgcttttgtgtatagtttatatggcacagtcatgatatttttaggagacacaagttttacaatggctctttattatgaatcagcgggtgttattttaaccttaattacattaggaaaatatttcgaagctgtttcaaaagggaaaacctcagatgcgataaaaaaattaatgggtttagcgccgaaaactgctcatattttacgtgatggcgtagaaattgaagtgccagttgatgctgttcagttggatgacattgtgattgttcgcccaggagataaaatccctgttgatggagtgattgtttcaggcagtagttctgtggatgaagccatgttaacgggcgaaagtttgcctgttgaaaagaaagtcggtgatgcagtaattggtgctagcatcaataaaaatggcagctttcaattcaaggcgacaaaagtgggaaaagagacggcccttgcccaaatcattcaattagtggaagatgcgcaaggctcaaaagcgccgattgcacaattagctgataaaatttcgggtgtttttgtcccaatcgtcattggtttggctgttctttctggcttggcttggttctttttaggacaagagtcatggattttcgctttgacaattactatttctgtgttagtgattgcttgtccttgtgcgctcggcttggcaacgccgactgcgattatggtggggacaggtaagggcgctgaaaatggcgttttaattaaaagtggggatgctttagaaaccactcacaaaattcaaacaatcgtgtttgataaaacagggactattacagaaggcaaaccggtggttacagatattttagttgctgattcagcactttcagaagctgagttactaacattagcagcttctgcagaacaaggatcagaacatcctctaggtgaagcaattgtgggagcggctaaagaacgtcaattgccattagcagaaggaagcgatttttcagcgattccaggtcacggcatccgtgtgacagtcaacgaacgagtcctacttttgggcaatataaaattaatgaaagaagaagcaatcgagctatcaacgtttgttcaacaagcggatcgtttggcagaagaagggaaaaccccaatgtttgtggcaaaagatggttcgtttgcgggtatcattgcggtagcagatactgtgaaggatagcagtcaaacagccattgcacgtttgcataaaatggggatcgaagccgtaatgattacgggagacaacaagcgtactgcagaggcgattgcgaaacaagtaggtatcgatcgtgtcttaagtgaagttttaccagaagataaagcgttagaagtgaaaaaactacaagcagaaggcaaaaaagttgcgatggtgggtgacgggattaatgatgcaccagcacttgcccaagcagatgtggggattgctattggttcaggcacagatgttgcaatggaatcggccgacattgtgctaatgcgtagtgatttaatggatgtgcctacagcagttgaattaagtaaagcgaccatcaaaaacatcaaagaaaatcttttctgggcatttgcctataatacattaggtattccagtggctatgggtgtgttacacttatttggtggacctttgttaagtccgatgattgcagcagcagctatgagttttagttcagtctctgtcttactaaacgccttacgattgaaaggatttaaaccttcgacggtgaaaagaactagtggaagtcaaaaa

SEQ ID NO: 9 - DNA, 1299 bp, Enterococcus faecalis
atgaaaaagaaaattttagcaggagcgcttgtcgctctgttttttatgcctacagctatgtttgccgcaaaaggagaccaaggtgtggattgggcgatttatcaaggtgaacaaggtcgctttggctatgcacatgataaattcgctattgcccagattggaggctacaatgctagcggtatttatgaacaatacacatataaaacgcaagtggcaagtgctattgcccaaggtaaacgtgcgcatacctatatttggtatgacacttggggaaacatggacattgcgaaaacaacaatggattactttttgccacgtattcaaacgcctaaaaattccatcgttgcattagattttgaacatggagcgttggctagtgttccagatggatatggaggatatgtaagttcagatgccgaaaaagcagcaaatacagagacaattttgtacggtatgcgcagaatcaaacaggctggctatactccaatgtattacagctataagccatttacactaaatcatgtaaactatcaacaaatcatcaaagagtttcctaactctttatggattgctgcgtatcctatcgatggtgtgtcaccatatccattgtatgcttatttcccaagcatggatggtattggtatttggcaattcacatccgcttatattgcaggtggtttagatggtaacgtagatttaacaggaattacggatagtggttatacagataccaataaaccagaaacggatacgccagcaacagatgcaggcgaagaaattgaaaaaatacctaattctgatgttaaagttggcgataccgtcaaagtgaaatttaatgtagatgcttgggcaactggggaagctattccgcaatgggtaaaaggaaacagctacaaagtgcaagaagtaactggaagcagagtattgcttgaaggtatcttgtcatggattagcaaaggtgatattgaattattgccagacgcaacagtcgtccctgataagcaaccagaagcgactcatgtggtacaatacggagaaacattatcaagtattgcttatcaatatggaacagactatcaaacgttggcggcattaaatggattggctaatccaaatcttatttatcctggtcaagttttgaaagtcaatggatcggcaacaagtaatgtctacacggttaaatacggcgataatttatctagtattgcagcaaaacttggcactacttatcaagctttagctgcattaaacggattagcaaatcctaacttgatttatccaggtcaaacattgaattat

SEQ ID NO: 10 - DNA, 1110 bp, Enterococcus faecalis
ttgccgatgattattaaacaggaacaattcataccaaaagatacagtagaaacaacgattgacttattaattagaaatttaacaacgattaaagataacacaggtgaatttctgttagattttgatggtttaaaagttgatgacaaaagttggacgatttggaactggccgcaaggcgttgggttgtatggtatatataagaattatcgaaatactaaaagtgaaaaagctttacaagtagttaacgactggtttgaaggtcggatgcaagaaggcgcgccgcctaagaatgtgaatacgatggctccgcttttaacaatggcttatctatatgaagacactaaagactctaaatatataccttacttagagcaatgggcggaatgggtgatggaagaaatgccccgaacgaatgaaggtggcttgcaacatgcgacatatggaccagaaaataaaaatcaattatgggatgatacgttaatgatgactgtcttacctttggcaaaaattggtaagttgttgaatcgactcgattatttggaagaagcaaagcatcaatttttaatccatattaaatatttacaagataaaaaaagtggtctatggtatcacggttggacttttgagggaaatcataactatgcggaagcactgtgggcaagaggaaactgctggattacgattgctattccagaaattattgaaatcttagagttgccaaaaggagatagtttacgggaatttttattgagtaccctcaatgcgcaagtggcagctttagcgaaataccaagatgaatctggtttatggcatacattaattaatgattcaaattcgtatttagaatcttctgctacagcgggattcgcttatgggattttaaaagcggttcataaaaaatatatttcttctgaatatgaagaagtggcaaacaaagcaattgctggcttactaaatgagattgatgaaacgggagaagtacaacatgtgtcagttggtacaggaatgggtgataatttagatttttatcgcacaattggaatgacagcgatgccttatggtcaatcattaacaatcctatgtttgactgaattgcttgtttcttattgc

SEQ ID NO: 11 - DNA, 3903 bp, Enterococcus faecalis
atgaaagcaaaaaaacaatataagacatataaagctaagaatcactgggtaactgtccctattctttttctaagtgtgttaggagccgtaggattagctactgataatgtacaagccgcggaattagatacgcaaccagaaacaacgacggttcaacccaataaccccgacctgcagtcagaaaaggaaacacctaaaacggcagtatctgaagaagcaacagtacaaaaagacactacttctcaaccgaccaaagtagaagaagtagcgccagaaaataaaggtactgaacaaagttcagctaccccaaatgataccacaaacgcgcaacaaccaacagtaggagctgaaaaatcagcacaagaacaaccagtagtaagccctgaaacaaccaatgaacctctagggcagccaacagaagttgcaccagctgaaaatgaagtgaataaatcaacgtccattcctaaagaatttgaaacaccagacgttgataaagcagttgatgaagtaaaaaaagatccaaacattaccgttgttgaaaaaccagcagaagacttaggcaacgtttcttctaaagatttagctgcaaaagaaaaagaagtagaccaactacaaaaagaacaagcgaaaaagattgcccaacaagcagctgaattaaaagccaaaaatgaaaaaattgccaaagaaaatgcagaaattgcggcaaaaaacaaagcagaaaaagagcgttatgaaaaagaagtcgctgaatacaacaagcataagaacgaaaacagctatgtcaatgaagcgattagtaaaaacctagtgttcgatcaatctgtcgtgacgaaagacactaaaatttcgtcgattaaaggcggaaaatttatcaaagcaactgattttaataaagtaaatgcaggggattcaaaagatatctttacaaaattacggaaagatatgggcgggaaagttactggcaacttccagaattcctttgtaaaagaggcaaatcttgggtctaatggtgggtatgcggttcttttagaaaaaaataaaccagtgacagtgacctatacaggactaaacgctagttatttaggacgtaaaattacaaaagcagaatttgtttatgaactacaatcctcaccaagccaaagtggaacgttaaatgcagtattttcaaacgatccgattatcacggcttttattggtacaaacagagtcaatggtaaggatgttaaaacacgcttaacgattaagttctttgatgcgtcaggtaaagaagtactaccagataaagatagtccatttgcgtatgcgctgtcttctttaaattcaagtttaacgaataaaggtggccatgcggaatttgtttctgattttggggcgaacaatgcgttcaaatacattaatggttcgtatgtgaaaaaacaagcggatggaaaattttactcaccggaagatattgactatggcacaggaccttctggattgaaaaatagtgattgggacgctgtaggtcacaagaatgcctactttggttcaggtgtaggtctagccaatgggcgtatttccttttcttttggtatgacaacaaaaggaaaaagtaatgtgcctgtatctagtgcgcaatggtttgcctttagtactaacttaaatgcgcaatcagtgaagcctattttcaattatgggaatccaaaagaaccagaaaaagcaacgattgaattcaatcgatacaaagccaatgtcgttcctgtacttgtgccaaataaagaagtcactgatggccagaaaaatgtcaatgatttaaatgtgaagcgtggcgattctttacaatacattgtgacaggggatacgacagaacttgccaaagtagatccaaaaacagtaaccaaacaagggattcgagatacctttgatgcagaaaaagtgacgattgatttatccaaagtgaaagtttatcaagcagacgcaagtctaaacgagaaagactcaaaagctgttgctgcagcaattaattcaggaagagctaaagacgtgactgcttcttatgatcttcatttagatcaaaacaccgtcacagcaatgatgaaaaccaacgcagacggttccattgttttagcaatggggtataaatatttacttgtcttgccgtttgtagtgaaaaatgtggaaggcgattttgaaaatacagctgttcagctgacaaacgatggtgaaacggtaacaaatacagtgattaaccatgtgccaggtagtaatccttccaaagatgtaaaagcagataaaaacggtacagttggcagtgtttcgctacatgacaaagatattccgttacagacaaaaatttattatgaagtgaaatcttccgaacgtccagctaactatggcggaattaccaaagaatggggcatgaatgatgtcttggacacgacccatgatcgtttcacagggaaatggcacgctattacgaattatgaccttaaagtaggggataaaacgttaaaagcaggaacagatatttctgcctacattcttttagaaaacaaagacaataaagacttaacgtttacgatgaatcaagcactattggccgccttaaatgaaggaagcaataaagtaggcaaacaagcttggtctgtgtatctggaagtcgaacggattaaaacaggtgacgtagaaaacacgcaaacagaaaactacaacaaagagctgatgcgttctaataccgtggtgacgcatacgcctgatgatccaaaaccaaccaaagccgttcataacaagaaaggggaagatattaaccatggaaaagttgctcgtggtgatgttctttcttatgaaatgacctgggacttaaaagggtacgataaagactttgcctttgatacagtcgatcttgcgacaggcgtttctttcttcgatgattacgatgaaacgaaggtgacaccaatcaaagacttacttcgtgtcaaagattctaaaggggtagacattacgaaccagttcacgatctcatgggacgatgccaaaggcacggtgacaatctctgccaaagacccacaagcctttattctagcgcatggtgggcaagaattgcgtgtaacgctccctacaaaagtcaaagccgatgtttctggggatatttataattcagcggaacaaaatacatttggccaacgaattaaaaccaataccgttgtcaaccatattccaaaagtgaaccctaaaaaagacgtggttattaaagtcggtgacaaacaaagccaaaatggcgccacaatcaaattaggggagaaattcttctatgaattcacaagtagtgacattcctgcagaatacgctggtgttgtggaagaatggtcgattagcgataaactagacgtcaaacatgacaaatttagtggccaatggtctgtgtttgccaattctaattttgttttagcagacggaaccaaagtgaataaaggggacgacatttcgaaactattcacgatgacctttgaacaaggggtagtgaaaatcacggccagtcaagcctttttggatgcgatgaatctaaaagaaaacaaaaacgttgcgcactcatggaaagcgttcattggtgtagaacgaattgcggcaggagacgtttacaacacgattgaagaatctttcaataatgaaacgatcaagactaatacggtagtgacgcatacgccagaaaaaccacaaacaccaccagaaaaaacagtgatcgtgccaccaacaccaaaaacaccacaagcaccagtagagccattagtggtagaaaaggcaagtgtagagccagaattgccacaaacaggcgaaaaacaaaatgtcttattaacggtagctggaagtttagctgcaatgcttggcttagcaggcttaggctttaaacgtagaaaagaaacaaaa

SEQ ID NO: 12 - DNA, 810 bp, Enterococcus faecalis
atgaaaaaaattctttttgctagtttatttagtgccacactactatttgggggaagtgaaatttctgcttttgcacaagaaattatccctgatgatactacgacaccgcccattgaagtaccaacagaaccaagtacaccagaaaagccaacagatccaacaccgccaattgagccacctgtagaccctgtagagccacctattacaccaacggagccaacagaaccgacagagccgacaacaccaacagaacctacaactcctacagagccaagtgaaccagaacaaccaacggagccaagtaaaccagtagaacctgaaaaaccagttacaccaagcaaaccagcagaacccgaaaaaactgtgacaccaactaaaccaacagaatctgaaaaaccagtacaaccagcagaaccaagcaagccaatcgacgttgttgtaacgccaacaggggaattaaatcacgctggaaatggtacacaacagccaacagtccctattgaaacaagtaatttggcagaaatcacgcacgtgcctagtgtaacaacacctattacaactacagacggagaaaacattgtagctgtagaaaaaggtgttccacttacacaaacagcagaagggttaaaacctattcaatcaagttacaaagtattgcctagcggaaatgtagaagtaaaaggtaaggacggtaaaatgaaggttttaccatacacaggtgaagaaatgaatatctttttatctgccgtaggcggtatcttgtctgtagtatctgggtttgtcatctttaaaaaacgcaaagctaaagta

SEQ ID NO: 13 - DNA, 906 bp, Enterococcus faecalis
atgggttcccggttcggactgatgttgaaacaaggtggtaacgatgttttgctaatcgacggctggcaggagcatatcaatgccatcaaagaaaacggattgaaggctaattataatggcgaagaaattactgttaaagtctcaattgttaatcagaatgaggtgcccactggtgagcaatttgatttgattatcttattcacgaaggcaatgcagttggaaaaaatgctgcaggatgttaaaccattaattgctgatcacacagaagttttgtgtcttttaaacggtatcggtcatgaagacgtaatcgaaaaattcgtaccgatggaaaaaatctttatcggcaacaccatgtggactgctggtctagaaggtcccggcaaggctaaattatttggcagcgggtctgttgaattgcaaaatctaggtattggccaagaagaatcagcgaaaaaattggcggaaactttgtccgcgtctggtttaaatgccaaatattccgacaacattcattattcaatttatcgtaaagcttgtgtcaatggtacgatgaatggcttatgcacgattttagacgtcaatatggcggggcttggtgcaaccaaacctgctcatgacatggtagtgactattgttaacgaatttgcagctgttgctgccaaagaaaacgtcaacttagacattcccgaagtaatcgaacatgtagaaacttgttttgacccgactacgattggtatgcatttcccatcgatgcaccaagacttgataaaaaataaccgtttgaccgagattgactacatcaacggagccatttctcgtaaaggtaaaaaatatggagtagtaactccttactgtgatttcttaacgcaactggttcatagtaaagaagaaattctaggagcgaaa

SEQ ID NO: 14 - DNA, 2568 bp, Enterococcus faecalis
atgcagacaacagaagaaatgcaatctggcgatggacgccgaggtcgattgcggatattttttggatttgcggctggtgttgggaaaacctacggtatgttgacagaggctcatgaattattgatgatgggaaaacatgttgttgtcggctatatcgaacctcatgatcgtccagataccaatcgattattagaaggattaccgcaaattcctcctaagaatattttttataaacaaatggttttaacagagccggatattgatcaaatcattcaacagaagcccgaaatcgtgttgattgatgaactggctcattccaatgcggaaggttctcgaaatcgtaaacgataccaggatattgatgaactgttgaatgcaggaatcgatgtttttactacggtcaatgttcaacatatcgaaagtttgaatgatatcgttgaagaagttaccggaattgaggtcaaggaaacggtgccggacacttttctacggcaagcgacaataagagtgattgatgtggagcccgatgagctgatcgaacgacttgaacaaggaaaaatatatgcgaatgaaaacgcgaaacgtgccttgaaaaatttttttattccacaaaaattggaccaattacgtggattagcaattcagcgagcgtcggatcatattaatcgaattagtggaaagacaattgggatacaaagtaaattattgacggtggtgaacgatgcctttccaaaaatgaccgaaaaatgtattcgctggacagcacgtttagcgcaaggtctagttgtcgattggacagtgattcaagttcgtacgcaagaaaatacaccaacgaacattcctttagccgataaattaggtgcggaggttattagtattgaagaggatgatagttttgagacgattgtcgagttcgcaaaaatgacgggtgttactgatattattatggggaaaaatctaaggcagccgtggtatgaaaaaatctttattgaagcgtttgatgatcgcttgttaaaacgattgaaagatacggaacttcatttaattcctttcaatgaagaaaagcggtctttattttttaagactcgtaaagtcattgagggtggcggaaaagatttagtgattgcaattggtggtgtttttctagcgacggtcgtgacggaattgatgcaatatatccacgttggcgatcaaaatctgatgcttatttatatttcattcgtattattagtcgctcgaacgacatccggttatttttggagctcattatcctctattttaagtgttttgtcttttaactggttttttgtcgaaccattatattctctgacagtatataaacagggatatccttttactttattgctcatgctagttgttgccctgatgagcagtaatttaatgattcgattaaagaaacaagcagatacttctatgaaaaaagagcaccaaatggaaattttgtacgaattgaacaaacgatatgttttagtggaaagtcgaaaacaaattcttgatatttctgccacttatttatcaagattattggaacgagaagtgattatttttgatcgtcaagtgaagacagagagtgttcattgtatcaacgaaaaaaaatcaatattaaataatgaagacgaagcagctgtagccttttgggcagcaaagaaccaaaaagaagctgggaatggtacagacacactaaatggagctaaaggattctatttgccgattgctgcaggcaggaagacgttggcggtattaggcattgaacgaaatgcagatcttgatttggaaaatgatcagctcaattacttaaaattggtgctgactcaaattgcggtcatcttggaacaaacagaattgaaagatgagaaagagcaagttgagttagaaaatgaacgggaaaaagtccgcagcaatttattacgagccgtatctcatgatctgagaacaccattaactgttatctcagggattgctgaaacattaggcattggaaatgatttaaaagaagagacacagcgaaaattattaaaggatattcaagaagagtcacaatggctgattcggatggttgaaaatcttttatccatcacgcgaatcaacatggatactatgaaggttaataaaactgctgaaccagtagaagaggtcatcgaggctgtttataagcatttgaggaaggtctatccagacggccaagtggatattcacctgccagaagaggtcatttttattcaagcggaccccattttgattgaacaagcgttgtttaatctgatagaaaatgcgtttcgtcatggagaaaatgatctaccagtcaaactaaacgtctatcaggaaaaagaacaaacagtttttgaaattgaaaatcacggcgaaattccattaaaacaatttcaaaagatccaatcaaacttgtccggcacaaatgaagtaccggttgactcaaaaaatggtttaggaatcggattgagtattgtaaaaacaatcgtccatgcgcacaatggtaaaatggaaatgacgataggtaggggcaaaacattggttcgaatttatttgaag

SEQ ID NO: 15 - DNA, 1740 bp, Enterococcus faecalis
atgaaaaatttttataaaaaaaaatttgctttaactgatcagggcgcagaagctttaactaaagcttctatttctagtttttttgtatactgcattaatatggtaccagcattcattataatgatgctgatagacgaattagttttagaaaatgcaaagccccgttggctttattttgcagtatcgtttgttactttgcttttcatgtattggttgttagatagggagtatgaaaacttatataatagtacttataaagaaagtgcgcatttaagagtgcaaattgcagacgatttgtcaaatttaccattatcctatttttcaaaacataatttatcagatttatctcaaactatcatgtctgacgttgaaggtattgagcatgcgatgagtcatgcaatacctaaatccggcggtatggctctgtttttcccttttatttcagtgatgcttttggttggtaatgtcaaaatgggattagctgttattttgccaacgttatttagttttgtcttaatcttgttatcaaagaaatcccaaacgaaagccaatactaaatattacgatactttgagagaaaactcggaagaatttcaagaaactattgaactgcagcaagagattaatagctttaatctatctaaaaaagttcaagacagacttttcaaaaaaatggaagagagtgaaaggattcatttaaaggtagaattaagtactttttcagtcatggccttatcctctattttctcatatgttagtttagcagtagtcattctagtaggtgttcacttactgttaacgggtgaagtgactatactctacgtcgttggttacttactagccgcaataaaaataaaggattccttcgattctatgaaagaagcagtgcttgaaatattttatttagctcctaaaatacagcgaattagagctatgaaggaaaccagtatccaagagggatcagatagtcctctgaaatcttttgacgttgagttgcgagatgtctctttctcatatgataacaataccccaattttagatcatatctcttttacggctaaacaaggagaagtgactgcgttagtaggtgctagtggttccgggaaaactagtatcttgaaattagtgtctagactgtatgattatgatgaaggctgtattttaattgatgggtatgatattaaacgtgtatctccagcttctttgtttagcaaaatcgctattgtttttcaagaggtaactttgtttaatacaagtattttggaaaatatacgtattggaaatagtcaagcgtcagatgaggaagtgaaaaaagcagctcgtttagctaactgcgaagactttattgaaaaactacctgacggttatcatacattggtcggagaaaacggaagttcactttctggaggagagcgacaacgcttatccatagcacgggcttttttgaaaaatgcgccaattttaattttagatgaaattactgccagtttagatgcggaaaatgaaaaacgtattcaggaaagtttaaatcgtttaatacaagataagacagtactaattatatcgcatcgcttgaagtctattgaaaaggtaaataaaattgtagtgatggatcaaggaaaagtagttgatcaaggtactcatagtgagttgtatcgaaggtcagaaatatacaaaaatctcataaagaaaactaaactatctgagaaattcgtctatgaaaaagaagctcaatcacga

SEQ ID NO: 16 - DNA, 1440 bp, Enterococcus faecalis
ttgactctttccgacacgttaggtcaacgagaagtaacggctctttcttacgattcgagagacgtaacagcagaaacactctttttttgtaaaggattaaactttaaagaaatctatttagaaaatgctgtaaaagacggcctagaaatctatgtttctgaggtgccttatgaggttccggcgcaactaggaattatcgtgactgacattaaaaaagcaatggctgtgttaagcatggctttttatgattatccacaaaataaattaaaactgattggctttactggaaccaagggtaaaacaacagcggcttatttcaccaaatatattttagatgttgctacacaacaaaaaacagccttgctttctaccatgaattcgacattagatggcaaaacattctttaaatctgccttgactacacccgaatctttggacttgtatcgaatgatggcaaccgctgttgctaacgggatgactcattttattatggaagtttcttcccaagcctacaaaactaatcgtgtctacaagttattttttgatgtcggcatttttttaaacattacccccgaccatatcagtccaattgaacatccaacctttgacgattacttttattgcaaacgtcaattgattacacattctaaagtcattgtgttgaatcacgaagctgattattttccattacttaaagaaactgcacaacagcaaaaagtcccagccattgtctatggcagtcagccggctccagaagtagactattcattcgctgtttcttcagaggattccttacgttttatcgttgaaagtcctgcagatgcgttaggattggccggctcttatcaccttcgtttaggtggtgattttaacaaaggtaatgcgttaagtgcggcgattgctagtgtccttgtgggagcttcaaaagaagagtgtcaacaaggaatcgcagcaaccaccgtccctggccggatggaatctttaacgaataccaacggtgcaaccgtctatgttgattacgctcataactatgacagtttgaagaatcttttaacctttgtccgtgaagaacatcctgacggccgcttaattgttcttgtcggtagcacgggagacaaagcgatttctcgccgcaaagactttggtagggttctttctgaattggctgatgttgcagtcctaacaaccgatgacccagccagtgaagatccagcaaaaatttgccaagaaattcaagcccatattaccaaagaaatgcctgtttacaccgttttagatcgtggcgaagcaattgctcacgcattatctttaagcacaacggctgatgatgcgattgtcttagctggtaaaggcgccgacctttatcaaaaagtaaacggcgtagatgaaccttacgcaggagactttgcccttgcggaagctttcattaataaaaagaac

SEQ ID NO: 17 - DNA, 1077 bp, Enterococcus faecalis
atgtttttaggatttaatgaaatgaagtattcaaaaggacggtacgtccttgtagtcttagtaatggtcttgattgcttggttaatttttattttgtcaggtttagcgaacggtttagctcaaggaaatcgtttagccgtagatcaatggcaagcgaatcaagtggttttatcaaaagaggccaatagtaatttaaatgtatcagtgttagatgaaaacgtgaaagaaacgatttcaggaggcaaaattgcaccgattggtcaacaatctttagccatccgcccagcagatgataaaaaggctgaattaacgaatgttagcttatttgggattgaaaaagaaagttttttaatgccaaaagtgattgaaggaaacgcatttactgataaaaatcaagtgattgcttcagaaacattgaaaaatcaaggatttaaaattggcgacaaattaactgcagggaaatatgatgagcaattagaaattgtcggctttatttctaaaagtagctataacattgtgccagttatttacacttctctggatacttggcggtcaattaaatatggtgacaatccagcaatggccaaaatggttaatggtttcattgttcgcagcaaggacaacacggaagttaaaacgactaataaagacagccaagttctttcaatttcagattttattgaaaaactgccaggatacagcgctcaaaacttgaccttggatggcatgatttatttcttgattgtgattgcagcgttcattatcggtatttttatctttgtgatgactttacagaaaacagcaatgttcggcgtcttaaaagttcaaggggtgccaactagtttcttagcaaaggcagtcatgctacaaaccgctttattggctgttctaggagtggcgattggtcttgctttaacgggaattaccgtgctctttttaccagaagcgatgccttatgcaactaatggaccacgcatgattttgtttagtgtactattgattttatctgcattaattggcggggcattttcaattcgaacgattgctaaaattgatccgttaatcgcgattggaggt

SEQ ID NO: 18 - DNA, 966 bp, Enterococcus faecalis
atgcaaatttttccctattcagatgatccaaataaacgctatcacacttggaactatgcacttcgtcaacagtttggtgaaaagatttttaaagtgccaattgatggtggctttgattgccccaatcgtgatgggacggttgccaaaggtggttgtacgttctgtagtgtttctggctcaggcgacatgattgttgcacctagcgatcccctgccgcttcaatttcaaaaagaaatccaattgatgcatcaaaaatggccaactgtcgatcaatacattgtttacttccaaaatttcaccaatacacatgcgcccgttgacgttattcgtcatcggtttgaacaagtagtcaatgaaaaaggtgtcgttggtttatccattggtacccgtcctgattgtttgcctgatgaggtagtgaactatttagccgaattaaatgaacgcttttatttatgggtagagttgggtttgcaaaccacgtttgaggaaactagcgctgccattaatcgtgctcatgattatcaaacatatctagatggtgtggctaaattacggaaacacgggattcgggtctgtacacatttaattaacgggctacctggggaaacacctgccatgatgcgcgaaaatgtgcggcgaactattcaggattcagatatccaagggattaaactgcacttacttcatttaatgacaaataccaaaatgatgcgggattataatgaaggacgcttacaattgatgagcaaagaagcctatgtttcagtgatttgtgatcagttagaaatgattccacccgaaattgttattcatcgcttgacaggcgatgctccctttgaaacaattatcggaccgatgtggagcttgaaaaaatgggaagttctcaatgcgattgatgcggaaatgaaacgccgcaacagttatcaaggaaaatatactgtcatttcaggaaaggaagttttcaat

SEQ ID NO: 19 - DNA, 2211 bp, Enterococcus faecalis
atgaagaaagaatcaatgtcacgtatcgaaagaaggaaagcacaacaaagaaagaaaacgccagtacaatggaagaagagcactactttattcagctcggcgttaattgtttcatctgtaggaacgcccgttgcgttactaccagtgactgctgaggcaacagaagagcagccaacaaatgcggaagttgcccaagcacctactacggaaactggcttagtagagacaccaacaacagaaactacgccaggaactacggaacaaccgacaacggattcgtcaacaacgactgaatcgacaactgaatcatcaaaagaaacaccaacaacaccaagtaccgagcaaccaacagctgattcaactacacctgtggaatcaggaacgactgattcttcagtagcagaaattacgccagtagctccttcagcaaccgagtctgaagcagcgcctgcggttacacccgatgatgaagtaaaagtaccagaagctagagtagcttctgcgcaaactttttcagcgttatcaccgacgcaaagtccttcagaatttattgccgagttagctcgttgtgcacaacctattgcgcaagccaatgatttatatgcatcagtgatgatggctcaagcaatcgttgaaagtggttggggagcaagtacgctatctaaggcaccaaactataacttatttgggattaaaggcagctacaatggacaatctgtctatatggatacatgggaatatttaaacggcaaatggttagtgaaaaaagaacctttccgtaaatatccttcttacatggaatcattccaagataatgcgcacgtgctaaaaacaacttctttccaagcgggcgtttactattatgctggggcttggaaaagcaatacaagctcgtaccgcgatgcaactgcttggttaacaggtcgttatgcgacagatcctagctacaatgctaaattaaataatgtcattaccgcatataacttaactcaatatgatacaccatcttctggtggaaatactgggggcggaacagttaatccaggaacaggcggctcgaacaatcaatcaggaacgaacacgtactatactgtaaaatcaggagataccttgaataaaattgccgcgcaatatggtgtgagcgttgctaatttacgctcatggaacggcatctctggcgatttaattttcgttggtcaaaaacttatcgtgaaaaaaggtgcttcaggtaacactggtggctcaggcagcggtggttctaacaataatcaatcaggaacgaacacgtactatactgtaaaatcaggggataccttgaataaaattgccgcccaatatggcgtgagcgttgctaatttacgctcatggaatggcatctctggcgatttaattttcgttggtcaaaaactcatcgtgaaaaaaggtgcttcaggtaacactggtggctcaaacaacggtggctctaacaataatcaatcaggaacgaatacgtactacacaattaaatcaggcgataccttgaacaaaattgccgcccaatatggcgtgagtgttgctaatttacgctcatggaatggcatttctggcgatttaatcttcgctggtcaaaaaattattgtgaaaaaaggtacttcaggtaacaccggtggctcaagcaatggtggttctaacaataatcaatcaggaacgaatacgtactacacgattaaatcgggcgataccttgaacaaaatttctgcacaattcggtgttagtgtggctaacttacaagcctggaataacatcagcggtagtttgatttttgctggtcaaaagattatcgtgaaaaaaggcgccaactcaggttcaacgaatacgaacaagcctacgaataatggtggcggtgcgacaacatcctacacgattaaatcaggtgatacgctgaataaaatttctgcacagtttggcgtgagtgttgctaatctacgttcatggaacgggatcaaaggcgatttaatttttgctggtcaaacaatcatcgtgaaaaaaggcgcttctgcaggtggcaatgcttcttcaacaaatagtgcatcaggcaaacgccatacagttaaaagcggtgattcactttggggcttatcaatgcaatacggaatcagcatccaaaaaatcaaacaattaaatggcttaagcggggatacaatttatattggtcaaactttaaaagttggt

SEQ ID NO: 20 - DNA, 693 bp, Enterococcus faecalis
atgatgattgttgtacttttaatgagtagttgcttatttttatttgtaagctatcaattgtatttgcgattacttgtcgaaaaactggattcagaggaccggacattaaagaggaaaataaatttctataagtatcagaaaaatagtcgtttaatgatttatttattgtttagtgtttgtctacttagcgtattattgttaggaattgtttatacatattatcaattaaatcaacgaaatatccgcatggaacaacggatcgagcgtttggcacagggccaagctactcaaggtgacaaaataaaaaaacaagcgattaaaaaaacagccttaaatcagtttccctggaagcaagctgtttcggcagaatcggccgctgtcttgactaattatgaattacaattagcgcgtgaatggcgtccttacctcggagagacgagtatcacaatgattagaagtgaaaaaacacaaaccttgacactgtctgttttttcagttggcttaagttaccatgaatttcaaacaggccaagacaatattgtagcacttattgcagcgttgaattcagttaaagaaattaccatgattgattttaattttacttatcgagatcaagagcaaacccttgtcaaatccattgatacgtatgctcgtgagacgttggaaacaaatttggagcctgtcgtgattagt

SEQ ID NO: 21 - DNA, 462 bp, Enterococcus faecalis
atgtctaactatactattatcgatttaaaccaacaaccacacttaattccgtcagctgctcaatggtttagccaaaagtggcaaatccccgctgaagcgtatcaagcaagtatgcaggaaatgctaactagcgaaaaccacgtaccacattggtgggtctgcttgaataaacagcaggacatcgttgcaggcgtgggcgtaattgataatgacttccacaatcgtgcagaccttacgccaaacctttgtgcattgtatgtcgaaccaacatttcgtcaccaaggcttagcaggaattcttttaacaacagttggtgattttctagctaattctggatttaaaaagctttatttgctcacagaccatactactttttatgaaagatatgactgggaatttttgacaatggtaaccaccgaagagcagtcttgcgctagaatttatcaaaaacaattacgtcaa

SEQ ID NO: 22 - DNA, 1026 bp, Enterococcus faecalis
atgaaaaattcagaaaatgattatatccaatctttattccaaattcttcccggcttgctaacagctttccttgtcgcctgccttagcaagtttcttgccatctggttacctagcttaggcgccgctacgatagctattttactaggaatctttttgggaaatacctttgttcgcggtgccaatttaaatcgcggaaccaaagtagccgaaagtaaattactagaattttctgttgttttattgggaaccaccgtgacctttcaaacgattgcccaaattggcttacaaggtgtcgcatttattctcattcaaatgtcgctgaccattatttttgcctatttgatcggtaaaaaactggctttttctgataatatgtctttattgatggctggtggtaatgccgtttgtgggtcttctgctattgcttcgattgctccagcaattcaagcagatgaggaagaaaaaggccaaatcattactttagtaaacttattaggaaccgttttaatgttgaccttacccattttaagtgggattctctatggtaccaatttgttggctcgtagcgcactaatcggagggactttacaatcagttggtcaggttgtcgccagtgccaatatggtcaatgagaacgcagttcaacttgcgatgctctttaaaattatgcggattgtcctactcgtagcagttgtctatttatttggacgtttcaagcaaagtaagacggcagaatcagaggctgagttggtagaagtcaccaaaaaaagcagcgccctaccttggtatgtagttggctttttcattgcctgtgtctttaatagtttgattcatttccccgtcgtgatcagtgagactgctcatttctttagttcttggtttgaaattactgccttggcagcaatcgggttacgactcgattttaaaaagtttttccaagaaggcaaacgtttcttaatctatggtttatcagtaggaactgttcaagtcgtcctagccattttgttgttggcactgctacagttc

SEQ ID NO: 23 - DNA, 1320 bp, Enterococcus faecalis
atggcaaaaacaggaatgtatgtaggcctcgatattggtacaacttctgtcaaagtagttgtcgctgaatatattgaaggtcaaatgaacatcatcggcgttggaaatgcaaaatcagacggtttgaatcgagggattgtcgtcgatattgatcaaacagttcaagcaatccaacgggccgttcgacaagccgaagaaaaagccggcattcaaattaaaagcgtaaatgttggattaccagcgaatttattagaagtagaaagctgtcaaggaatgatagctgttagcagtgaatcaaaagaaattacagatgaggatgtgcgcaacgtcgcatctgcagctttggttcgttcaactcctcctgaacgtcaaattgttgcaatcttaccgcaagactttaccgtcgacggctttgaaggcatcaaagacccacgtggaatgcttggcgttcgcatggagatgtttggcgttgtctatactggaccaaaaacaatcatccataacatccgtaaatgtgttgaaaaagctggcttaggaattaacgaattagtgattacaccgcttgctttaacggaaacaattttaacagatggcgaaaaagactttggaacaattgtcattgatatgggtggcggtcaaacaacgacatctgttatccacgacaaacaattgaaatttactcatgttaaccaagaaggcggcgagttcatcacgaaagatatctcaatcgtattgaatacttcttttaacaacgccgaagccttaaaaattaattatggggatgcttatccagaaagaacttcagcaaacgaagagtttcctgttgatgttatcggtaagtcagagcctgtaagagtggacgaacgttacctttcagaaattattgaagcgcgtgtggaacaaattttgagaaaatcaaaagaagttctggatgaaattgatgcgtttgaattacctggaggcgttgtgttaactggtggcgccgctagtatgccaggtattgtcgatttggcgcaagagatttttgaagccaacgtaaaactatacgtaccaaatcacatgggcttacgtaacccagtctttgctaatgtcattagcattgtggaatattcagcgcaactaaacgatatttatcacattgccaaatatgcaatccctggtgaaaaatcgaaaccagcacaatcagtcgctgtccaacaagaagttcgctatgacacatatgctgaacagcctcaagaagaatacgaagaattcaacgaacgtgagtctggtgaaaaagtgacaggcaaaatcaaagacttcttctcgaacattttcgac

SEQ ID NO: 24 - DNA, 315 bp, Enterococcus faecalis
atggcaaaaaaaacaattatgttagtttgttccgcaggaatgagcacgagtttattagtaacaaaaatgcaaaaagcagcagaagatcgtggcatggaagcagacatctttgcagtatcggcttctgaagcagatacaaacttggaaaataaagaggtgaatgttttacttttaggtccacaagttcgtttcatgaaagggcaatttgaacaaaaattacaaccaaaagggattcctttagatgtaattaacatggcagattatggcatgatgaatggcgaaaaagttttagatcaagcaatctcattaatggga

SEQ ID NO: 25 - DNA, 810 bp, Enterococcus faecalis
atgaaaaaagagatcattgtttatactatttccgattcacttggagaaacatcacaaaaattgttagctgcagcaagcgcacaatatccagatatttcttttcttaatcgatacaatttttcttttgtcacaacagaagaagaattattagagattttaaaagatgccttaaaagataaagccttagttgtcagtacattagtcagtaaacaactaatcacagcggcgaaagaatttagtgaacgaacagggttgttatatttagatttaatggcgccattttttgaattaattcaagcgaaagccggagtagatcctattgaagagcctggacgacgccaccaactagatcgtgcctattttgataaaatctcagcgattgaatttgctgtaaaatatgatgatggcaaaaatcctcaagggtttcttgattctgatatattgttgttaggcgtttcgcggacctcaaagacgccagtcagtatgtatttagcgaatcaaggctaccgcgtttctaacttaccattaattccagaagttccattgccgccaattttggaagaaatggatccacaaaaaatgattggtttagtttgttcgccagaaacattaggacagattcgtagcagtcggttggcttccttaggtttaggtaatgagaccagttataccaatgttgaacggattgaacaagaattagcttatgccgaagagatttttgcgaagtatggcatcccagtgattgatgtaaccgcaaaatctgtcgaagaaacagcctttttaattaaagaaaaactagatgaaagaaat

SEQ ID NO: 26 - DNA, 2235 bp, Enterococcus faecalis
atggaatggattgaaattaagcacgcaacacaaaataatttgaagaatatctctgtcaatatccctaaaaagcaactaactgttgttactggactttcgggttcaggaaagtcctccttagtatttgacacattagccgctgaatcacgtcgtgaactaaatgatacatttagttcgtttgttcaaaattacttacccaaatatggtcgtccagaagttgaaaaaatcgagaatcttcctgttgcaattgtcattgaccagaaaaaagtagcaggtaattctcgttcgacagtgggaacgtacacagatatttatacgtttttacgtttgctgttttcacgagcaggttctccatttgttggttattcagatactttttcgtttaatcatccggatggaaaatgtccaacatgcgatggcttaggaaagattaccgaaatcaatcttcatcagctagttgattatgacaaatcattaaacaaagggcctatcgatttccccacatttacagttggcaactggcggtggaagcgttatgcccatagtggtctatttgatttggataaaaaaatcaaggactattctcctgaagagttagcattatttttatatgctccacaacaaaaactagctaatccacccaaagagtggcctcatacagctttgtatgaaggaatcgtcccgcgtatgcaacgtagcatattgcatacagacgaaggcaaacgtcatcaaaaataccttaatcactttgttaccgtaaaaagatgtcctgattgtttaggaagtagagtcaatgaacgtgttcgtagctgcaaaattaatcagaaaagtattgctgatgctgttgacatgccactcactgaattacattcttttattcgttcaatggacctatccttaataaaaactattcaagaagagctacttgtacgtctagaagcattaattaatatcggtctctcctacctcacattaggacgagcaactgaaacactttctggtggtgaagcacagcggattaaaattgctaagtatgtaaacagcgccttaaatgatattatgtatattttagatgaaccaagtgctggcttacatccaaaggacatcgaacggatcagtcgtgcattgctcaatttaaaaaataaaggaaacaccgtggttctcgtggaacataatccacaattaattagagaagctgattttatcatcgatatcggacctttcgcaggcgaaaatggtggccatgtccagttttcaggaacgtatgacgcatttttagtctccaaaaccttgactagtcaagcgcttcaagagccgctccctttaaacgaccaaccaagaaaagcaaggaagtctttatcaatcgaacatgcgacactgcataatttaaacaatctatctgtcgaagttccgttaggagttttgactgttatttgtggggtcgctggttcaggtaaatcatcattagcggaagaaatttatcaaaaagcccaggctgataaccaagaaattattcatctttcacaaaaaagcattaccgcaaatttacgatccacacctatgacctatcttaatatttttgataaggtccgcaaactgtttgcggaagaaaatcatgttagtccagctttatttagctataattccaaaggcgcctgtcctacttgcaaggggaaaggcataattgtctccgatatgtcttttatggaggatgttactagtatttgcgaaacctgtcacggaacgcgttacaaagaagaggtgcttcattatctgtataacggaaaaaatatcgttgaagtactagctttaagcgttaaagatggctatgattttttcaaagaccagccttttgctctttcattaaaaaatttactggaagttggcttaagctatcttaaactcaatcaatcgctctcaacattatctggtggcgaattgcaaagggtaaaattagcagacacacttcaccaaaaaaaagctatctatttaatggatgaacctacagatggtttacacttaattgatatccaacaaagtcttcaacttttcaatcgaatggtagaagaaggaaacagcttgattttattagaacatcacattgatgtgattaaaagtgccgactggttgattgaactaggtcccgaaggtggaaaaaatggcggacagcttctttttacaggaaccccagcaaatatgctaaattccactcattctattactaaaggctatctg

SEQ ID NO: 27 - DNA, 1659 bp, Enterococcus faecalis
atgaagaaattaaaaatgttaggatgcgtcgggttgcttttagctttaacggcttgtcaggcgggaacgggaaactcggctgatagtaacaaagcagcggaacaaaaaattgcaattagttctgaagcggctatttcgacaatggaaccacacacagcgggggatacgacctcgactttagtcatgaatcaagtttatgaaggactctatgttttaggtaaagaagatgaattagagttgggggtcgctgccgaagaaccagcgatttctgaagatgaaaccgtttatacatttaagattagagaagatgccaaatggtcgaatgatgatccagtaacagcaaacgactttgtttatgcatggcaacaagttgcttcccctaaatcaggatcgattcatcaagctttattttttgatgtcattaaaaatgctaaggaaattgctttagaaggcgcagatgtgaatactcttggggttaaggcgctagatgataaaacgttagaaataactttagaacggcccaccccttatttgaaatcattactttcgtttcctgttttgtttccacaaaatgaaaaatatatcaaagaacaaggggataaatatgctactgatgcagaacatttgatttataatggtccttttaaattgaaagaatgggataatgcctcttctgatgactggacctacgaaaaaaatgatacgtattgggatgctgaaaaagttaaattaacagaagcgaaagtttcagtaattaagagcccaacgacagcggtgaatttgtttgactcgaatgaattggatgtagtgaataagctaagtggtgaatttattcctggttatgttgataatccagcctttctttcaattcctcaattcgtcacatactttttaaaaatgaacagcgttcgtgatggaaaagaaaatccggctttagcgaacaacaatattcgtaaagcgttggcacaagcttttgataaagaaagttttgtaaaagaagtcttgcaagatcaatcaacggctacagatcaagtaattccgccgggacaaacgattgcgccagatggaacagatttcacaaaactagctgctaagaaaaataactacttaacctacgatacagcgaaagcaaaagaattctgggaaaaagggaaaaaagaaattgggctggataaaatcaaattagaatttttaacagatgatacagacagcgccaaaaaagctgctgagtttttccaatttcaattggaagaaaatctagatggattagaagtgaatgttactcaagttccttttactattcgtgttgatcgtgatcaaacgagagactatgatttagaattatctggttggggaaccgattatcgtgatccattaacagttatgcgcatctttacttcggatagtaccttgggcggcgtaacgttcaagagtgatacgtatgatcaattaattcaagaaactagaacaacacatgcggctgatcaagaggctcgtttaaatgactttgctcaagcacaagatattttggtgaatcaggaaacggttttagcaccaatctacaatcgaagcatttctgtattagctaatcaaaaaatcaaggatctgtattggcattcatttggacccacgtacagtttaaaatgggcttatgttaac

SEQ ID NO: 28 - DNA, 1875 bp, Enterococcus faecalis
atgaagcaattaaaaaaagtttggtacaccgttagtaccttgttactaattttgccacttttcacaagtgtattagggacaacaactgcatttgcagaagaaaatggggagagcgcacagctcgtgattcacaaaaagaaaatgacggatttaccagatccgcttattcaaaatagcgggaaagaaatgagcgagtttgataaatatcaaggactggcagatgtgacgtttagtatttataacgtgacgaacgaattttacgagcaacgagcggcaggcgcaagcgttgatgcagctaaacaagctgtccaaagtttaactcctgggaaacctgttgctcaaggaaccaccgatgcaaatgggaatgtcactgttcagttacctaaaaaacaaaatggtaaagatgcagtgtataccattaaagaagaaccaaaagagggtgtagttgctgctacgaatatggtggtggcgttcccagtttacgaaatgatcaagcaaacagatggttcctataaatatggaacagaagaattagcggttgttcatatttatcctaaaaatgtggtagccaatgatggtagtttgaaaaaagtaggaactgctgaaaatgaaggattaaatggcgcagaatttgttatttctaaaagcgaaggctcaccaggcacagtaaaatatatccaaggagtcaaagatggattatatacatggacaacggataaagaacaagcaaaacgctttattactgggaaaagttatgaaattggcgaaaatgatttcacagaagcagagaatggaacgggagaattaacagttaaaaatcttgaggttggttcgtatattttagaagaagtaaaagctccaaataatgcagaattaattgaaaatcaaacaaaaacaccatttacaattgaagcaaacaatcaaacacctgttgaaaaaacagtcaaaaatgatacctctaaagttgataaaacaacaccaagcttagatggtaaagatgtggcaattggcgaaaaaattaaatatcaaatttctgtaaatattccattggggattgcagacaaagaaggcgacgctaataaatacgtcaaattcaatttagttgataaacatgatgcagccttaacttttgataacgtgacttctggagagtatgcttatgcgttatatgatggggatacagtgattgctcctgaaaattatcaagtgactgaacaagcaaatggcttcactgtcgccgttaatccagcgtatattcctacgctaacaccaggcggcacactaaaattcgtttactttatgcatttaaatgaaaaagcagatcctacgaaaggctttaaaaatgaggcgaatgttgataacggtcataccgacgaccaaacaccaccaactgttgaagttgtgacaggtgggaaacgtttcattaaagtcgatggcgatgtgacagcgacacaagccttggcgggagcttcctttgtcgtccgtgatcaaaacagcgacacagcaaattatttgaaaatcgatgaaacaacgaaagcagcaacttgggtgaaaacaaaagctgaagcaactacttttacaacaacggctgatggattagttgatatcacagggcttaaatacggtacctattatttagaagaaactgtagctcctgatgattatgtcttgttaacaaatcggattgaatttgtggtcaatgaacaatcatatggcacaacagaaaacctagtttcaccagaaaaagtaccaaacaaacacaaaggtaccttaccttcaacaggtggcaaaggaatctacgtttacttaggaagtggcgcagtcttgctacttattgcaggagtctactttgctagacgtagaaaagaaaatgct

SEQ ID NO: 29 - DNA, 444 bp, Enterococcus faecalis
atgaaaacgccaacgtttggaaaaagagaagagacattgacctatcaaacaagatatgctgcatacattattgtttcaaagccagaaaataacacaatggttctggtacaagcgccaaatggagcttattttttaccaggaggcgaaattgaaggcaccgaaacgaaagaagaagcgatccaccgagaagtgctagaagaattaggaattagtgtagaaattggctgttatttaggggaagctgatgaatatttttattcgaaccatcgccaaactgcctattataatcctggatatttttatgtagcgaatacttggcggcaacttagcgaacccttagaaaggaccaatactttacactgggttgcaccagaagaagcagtccgtttattaaaaagaggaagccaccgttgggccgttgaaaaatggctagcggcagcatca

SEQ ID NO: 30 - DNA, 456 bp, Enterococcus faecalis
atggcacgcgtagaaagttttgaattagatcacaacacagtaaaagcaccatatgttcgccttgctggcacagaacaaaatggtgatgcgttagtcgaaaaatatgacttacgtttcttacaaccaaacaaagatgccctaccaacaggcgcattacacacgttggaacatttattagcagttaacatgcgtgatgaattaaaaggaatcattgacatttcgccaatgggttgccgcactggtttttatatgattatgtgggatcaacattcaccacaagaaatccgtgatgcattagtcaacgttttaaacaaagtaatcaatacagaagttgttccagcagtctctgcaaaagagtgcggaaactacaaagatcattctttatttgcagcgaaagaatacgcaaaaatcgtcttagaccaaggaattagtttagatccatttgaacgtattctg

SEQ ID NO: 31 - DNA, 480 bp, Enterococcus faecalis
atgaacatttttgctgtccgtttaaaagaggctttaacagccaagaacatcaaacctagtgatttagcgaaaaaaactggcatcggtaaatcttcgatcagcgattggctagctggtcgttacgaagcaaaacaagacaaagtttatcgcattgcagatgcattagacattaatgaggcctggttgatgggacaagaagttcccatggaaaaaaatgcctcaactatcgaccgcatttataaaaaattagaaccccaacgacaagccatcgtttatcaatttgccgaacaacaattacacgaacaacaaacgcaagcagaaattctctcattccctcgccgtgacgaaatgacactggctgcccacgctggggatccagaaaagatattttcaaaagaagagatcgagaaaattcacgattacttggatgaaattgatgccaaatatcaacaatcgatttcttctgacaaaaaagaggat

SEQ ID NO: 32 - DNA, 924 bp, Enterococcus faecalis
atgtataaatttgttgataccaatcaagcaactcattcaacgcctcttccttcagaagcgttgaattttaacggccaatttttagaaaaagtcatccctggctatcaaacattatcagtttcaggacgagaattagttccaagcgaaattgaaagctatcaattagggattcgtgatggtaaacgtcacgtttatgcgcgaattccagaacgagaattaacagtcaaatatcgcctttcagctgtgaataatgaagcatttcgagatgcatttaatcatttaaacgttgctttgtttacggaaaaagacgtttctatttggtttaacgatgaaccggaaatgctgtggtttggcagtaagtcttcagtgagtgatgtacccgaaggtgttaaccaagtaacaggcacctttactttattgctttctgatccgtataaatacacacggagtgatgcgactagtgtgatgtggggttcgccaaccattacatttcaagcgaattacttaatggggaatacaggctcaggtgcatttgattttccaattttaattgaaggcggggcttattggggatcaaccatgattacctttcaaaatcgggcttacacgatgggggatttaggcaaagaagttcggccaattgaaatttatcctacggttgaaggattaaaagtcaaaccgaccattattttaacaggaaccggacgtggtgtttggattaaaacacggaacgatacaattaacttaggagactttgatcgttcggaaattattatcgatactgaaaatttttatctgacaaaaaatggtgcaccgatgattcgaccaatgaacgatttttatctatatcccaatgaaccgctgtatattcaagccaaagatagcgacttccgcttgacgattcgctatcctaaccgatttgtg

SEQ ID NO: 33 - DNA, 822 bp, Enterococcus faecalis
atggattttttcagtagtgaagaaatagttgcaagcttaggtgataaggcagaaatgaaagggaaattatcgtttgttcgactctgtattttaggcatcatggctggtttttgtattgcactgggttacttggcgtttattcgtatcactggaactgcccccacagaatggggaagttttaacaactttctgggtggagctttatttccagttgggttgatagcgcttacttttgttggtggtgagttagcaacaggcaatatgatggtaatgacattaggcgtattacagaaaaaggttcgagtgggcgctctttgttataactggatagttgttttattgaccaattgtctaggcggatttcttgtggcgtatttatttggccatattgttgggttaactgaaggtgcgtttctggataaaacagtcgcagttgctcaggcgaaaattgctgatccaccgctagttgcttttgtttcagggattggctgtaatatttttgtttgtttagctgtttatctcggagcgttggcaaaatcatatttaggtaaaatgtttggcttatggtttcctgtcatggttttcgttgtttgtgggtttcaacacgtggtcgctaatgcatttattattccagcggcaattttttcacaaagtaccacaatcagttggtgggattatttgcagaatacattatgggtatttttaggcaatgcagtaggtggcagtctttttatggccgtaccattgatctttatgacaaaaccagcaactgtcaaaccaagagttgagaaaacgattcagacggaggagctctatggcaat

SEQ ID NO: 34 - DNA, 2364 bp, Enterococcus faecalis
atgaatcagcgtattctatcaacattagggtttgataaagtaaaacaacagttgttgcaatttattgtgacagctcaggggacaaacgaagtttcggaattattaccaattgctgatgaaaataaaattcaatcatggctaaatgaaacacaggatggtttaaaagttcaacgattacgtggtggaatccccattcctaaattagaaaatatccaaccacacatgaaacggattgaaattggtgcggatttaaatggcatagaattagcacaagtaggccgtgtcttgtcgactacttcagaactgactcgtttttttgatgagttaagtgaaaatgaagttgattttgaacgtttatatatgtggcgagagcaactagaagttttgcctgaattaaatcgccaactcaaacaagccattgatgatgatggctacgtcacagatgaagcttcgccagccttaaaggcaattcggcaaaatattcgtcgtagtgagcagaccattcgagaagaactagatagtattattcgtgggaaaaacgcacgttatctgagtgatgcccttgttactatgcgaaatgaacgctacgtaattccagtcaaacaagaatataaaaatatttttggtggcgtggttcacgaccaaagtgcttcaggacaaaccttatttattgaacctaaacaaattttagaaatgaataatcgtttgcgacaacaacaaattgccgaaagaaatgagattactcgcatcttggcagaactgtcggctgagttggttccttatcgccgagaaattacgcataatgcttatgtcattggtaaacttgattttattaatgctaaggcgcgactaggaaaagaactaaaagcagttgttccagaaattagtcaagcaaatcatgtagtttttaaacaagcccggcacccactattaaatccagaaaaagctgtagccaatgacattgtgattggagaagaatatcaagcaattgtgattacagggcctaataccggcgggaaaaccattactctgaaaacgttaggtcttttacaattaatgggtcaagctggattacctattccagttgaagaagagagtaaaatggggatttttacagaagtatttgcggatatcggggatgaacaatcgattgaacaaagtttaagtactttctcttcacatatgacgaatatcgtgtctgtcttaaagaaagtcgatcatcaaagtttagtactatttgatgaattaggtgctgggacagatccgcaagaaggggccgctttagcgattgccattttagattcattgggcgctaaaggagcctatgtgatggcaacaacccattatcctgaattaaaagtgtatggctataatcgagctggaacaatcaatgccagtatggaatttgatgtagatactttgagtccaacctatcgtttattaattggcgtgcctggccgaagtaatgcttttgaaatttcgaaacgtcttggattagacaacagtattattgaggctgcaaaacaaataatggacggtgaaagtcaagatttaaacgaaatgattgaagacttggaaaaccgtcgcaaaatggccgaaactgaatatttagaagctcgccactatgtcgatgaatcggccgctttgcataaggaactgaaagaagcctatcaagtattttttgaagaacgagaaaaagaattacaaaaagcacggaaagaagcaaataaaattattgcagaagcggaagaaaacgcagaaaccattatttctgatattcgcaaaatgcaattggaaagtggccaacaaggtggtgtcaaagaacatcagttaattgatgcgaaaacacaactttctcaattacaccatgaagaaaccaagcttgctaaaaacaaagtgctgaagaaggcgaaagaacagaaaaaattaaaagctggcgatgaagtaattgtcaatacttacggccaacgagggaccttattaaaagacaacggcaaaggacaatggcaagtccaattgggcattttaaaaatgaacgtatctgaagaggatatgacgcctgtcgctccacaaaaagaagcgaaaccaagagttacaacggttcgttctgcagaaagcagtcatgttggcacacaactagacttacgtggcaaacgctacgaagaagcattggcagaagttgaccaatacattgatgctgcgattctagcgggctatccacaagtaaccattgttcacggcaaaggaacaggtgcattaagaaccggaataacggaatttttaaaaaatcaccgcagtgtgaaaagctatgaatttgcgccacaaaaccaaggtggtaatggtgcgactgtcgtaaaattccaa

SEQ ID NO: 35 - DNA, 864 bp, Enterococcus faecalis
atgaaagaaataactggagccactcgtttagctgggctattcgcgaaacccagccaacacagtatttcaccgttgattcataatacagcatttcaaaatttaggagttgatgctcggtatctggcgtttgacgttggacaagagacattgccacaagcaattgaagcgattcgaacgtttcacatgttaggggccaacttatcaatgcccaataaagtggcggctgtaagttatatggatgaactaagtcctaccgctcaactggttggcgcaattaatacgattgtcaacaaagatggaaaactttacggagacagcacggatggtactggttttatgtggagtttgaaagagaaaaaggttgacgtttttcagaataaaatgaccatcttaggaacaggtggtgcagccttatcaatcattgcccaagctgctttagatggcgtgaaagaaatcgccgtttacaacaggaaaagcgcgggctttaacgacagtcaaaaaaaactggcaaatttcactgaacgaaccaactgtgtaattcatttaaacgatttagcggatactgaaaaactagcaaaagatgttgctgaaagcgtcttgttagttaatgcaacgagtgtgggtatgcatccacatgcgcatagtagtcctatagaaaattatgcaatgattcaaccgaagttatttgtgtatgatgctatttataatcccagagaaacacagttattaaaagaagcccgtttacgtggtgcagaaacaagcaacggcttggacatgctactttatcaaggcgctgctgcttttgaacaatggacaggacaaaaaatgcctgtatcagtcgtaaaacgtaaaattgaaaataga

SEQ ID NO: 36 - DNA, 930 bp, Enterococcus faecalis
atgactaaaggttatgtaaaatcagtaacagagttaattggtcaaagcccagttgtgaaattaaaacggatggtaccagaaggagctgcagatgtttttgttaaactagagttctttaatcctggtggcagtgtgaaagatcgaattgctttaagcatgatccaacaagccgaagcagatggtcgcctaaaacctggacaaacgattattgagccgactagtggtaatacaggcattgggttagcaatggtaggtgctgcgttgggatatccagttaagattgtgatgccagatactatgagtattgaacgccgcaaattaatgcaagcatatggggctgatctattattaacccctggtgccgaaggaatgaaaggggcaattgcaaaagctacagcattagcagaagaacacgggtacttcatgcctttgcaatttaataatccagctaatccaatggtacatgaacaaaaaacaggaaaagaaattgttgatgtctttggtaaacgtggcttagatgcgtttgtttctggtgttggcactggaggaaccgttacaggagttggccatgaattgaaacggatttttccagatattgaaattgttgcagtagaaccaacagagtcgcctgttttagaaggtggcgaaccaggtccacataaaatccaaggaataggcgctggttttgtcccagaagttttagacaccaccgtttatcaaaaagttgccgctgtttctagtgaagacgcattagaaactgctcgtttaatggggccaaaagaaggtatccttgtggggatttcagcaggggcagcaattaaagctgccattgatttggcagtcgaattaggcgcaggcaaacgtgtcttagcgctggttccggataacggtgaacgttatctttcgacagctctttacgaatttccagaa

SEQ ID NO: 37 - DNA, 1434 bp, Enterococcus faecalis
gtgaaaaatcaacatttaactacgtcacaaggaagtccagttggcgataatcaaaattcgctaactgcaggagaatttggtcctgtcctaatccaagacgttcatttattagaaaaattagctcattttaatcgtgagcgcgtaccagaacgggttgttcatgccaaaggtgctggtgctcatgggattttcaaggtgagccaatcaatggcacaatatactaaagccgattttttatctgaagttggcaaagaaacacctttattcgctcgtttttcaactgtagctggagagttaggttcatcagatacattgcgtgatcctcgcggttttgcgcttaaattctatacagacgaaggaaattacgacttagttggcaataatacgcccatttttttcattcgtgatgcaattaagtttccagattttattcatagccaaaaaagaaatccgcggacgcatttgaaaagtccagaagctgtttgggatttttggtctcattcaccggaaagtcttcatcaagtaacaattttaatgagtgatcgtggcattccgttgtcgttccgtcatatgcatggttttggtagccatacattcaaatgggtcaatgctgctggagaagtattttttgttaaatatcacttcaagacgaatcaaggaatcaaaaatctagagagtcaattagcagaagaaattgctgggaaaaacccagatttccatattgaagatttgcataatgcaattgaaaatcaagaatttccttcttggacattatctgtgcaaattatcccgtatgcagatgcgttaacaatgaaagaaacactttttgatgtaacaaaaacggtttctcaaaaagagtatccgctgattgaagttggcacgatgactttaaatagaaatccagagaattattttgcagaggttgaacaagtaaccttttcaccagggaatttcgttcctggtattgaagcttctccggataaattattgcaaggacgtttgttcgcttatggggacgcacatcgtcatcgcgtgggcgctaatagtcaccaattgccaatcaaccaagcaaaagcgcctgtaaataactaccaaaaagacggcaatatgcgttttaacaatggcaatagcgaaattaattatgaaccaaatagttatactgaaacaccaaaagaagatcctacagcgaaaattagttcctttgaagttgaaggaaatgttggtaattatagctataatcaagatcactttacacaagcaaacgctttgtataatttgctgccaagcgaagaaaaagaaaacttaattaacaatatagcggcatctttaggtcaagtgaaaaatcaagaaatcatcgcgcgtcaaattgatttgttcactagagtaaatccagaatatggagcacgtgtcgcacaagccatcaagcaacaagca

SEQ ID NO: 38 - DNA, 1926 bp, Enterococcus faecalis
atggcagaaaattatcagcaggcagccaaagacattattcaattaatcggtatggataacattatatcggtcacccattgtcaaacgcggttacgttttattttgaaggaccatgaacaagtagatggtaaacaactagaaaaaatcgatttagtcaagggggttttttataatggtggtcaataccaagtgattttaggaactggtattgtgactaaagtgtatgatgaaatagaaaaacttggaatcaatgttgtgtcaaaagcagagcaaacagcaattttaaaaaataatgaaacaggcatgcgcaaaacaatgcgcattttaagtgaaatattcattccaattgttccagtaattgcagcaacaggattgttcctagggttaaaaggtgttatttttaacgatacttttttacaattattcggagcaagtgtagccaatattcctgaaagctttcaacaaattgtctctgtcattacagataccgtctttgcctttttgccagctttgattgtttggtctacctttaaagcatttaatgcgacgcctgtaatcgggattgttattggtttaatgatggtatcacccattttaccaaacgcttatgcagttgcaacaccagattctggcgtgaaagctattatggcttttggttttatcccagttgtcggtgcacaagggtccgttttaagtgcaattgctgctggtataattggcgcaaagattgaactttttttccgaaaaaagatgccgaatattcttgatcaaatttttacaccctttatgactatgttaattacttttttaatcatgattctcggaattggcccaattttgcataccgttgagttaggcatggtagatgttgtccaatggttgattgggttgcccttaggattaggtggtttcgtgattggtgcctcatatcctttaatggttttgattggtattcatcatacactaactatggtagaaacatcattattagcaaatacaggatttaatgcattgattacaatatgtgccatgtatgggtttgccaacgttggcagttgtttagcctttgcgaaaaaagcgcaagatagcaaagtgaagtcgacagccattggttctatgttgtctcaattatttggagttagtgagcctgtgttatttggattacttattcgttggaacttaaaaccgctgctatgtgtcttgtttacatcaggtttaggcggagcaattttagctatttttcatattcaatcaaattcttatggcttagccgttattccttctttcttaatgtatatctatagtgcacatcaattagtgatctatttattagtcgcacttttatctgtcggtgtatgttatgcattaaccagtctatttgcaattccgcaagaagttttgatttcagataaagtaatcgaagaggaagaacgcgaagtctttgaaatgcaacacaataccttagatgaacaacttttttctccggtaactggttacgccatgaatcttactgctgttaatgacccagtattttcaagcgagatgatgggcaaaggtttagcaatcatgccaacagcgaacaaggtttacgcgcctgcagatggtttattaaacttggttgcagaaactgggcacgcttatggtatccaaacggacgcaggagctgaagtattaattcatataggaattgatactgtcacattgggacaggaggtctttcagacacaagtaacccaaggtcatcgtgttaaaaaaggagatcttttaggaacgttcgatcgaaaagccattaaagaagctgggcttgactcaactgtcatggttatcattacaaatacttcaagttatttaagcgtagagccaatgatgtcagatcataatgaaattacgccggaacaaatcattttaaatctaaatacacctaac

SEQ ID NO: 39 - DNA, 1476 bp, Enterococcus faecalis
gtggaattagtagataaagacttacgttccatccaagaaacaagaaatttaatcagaaaagccaaagaggcacagcaagtattagcaacattttcgcaaaaacaaatcgatgcgattgttcaagcggtttcagaggctacatttaaccaacgagaaaagttagcgaaaatggccaatgaagaaacaggatttggtatctatgaagataaaatcatcaaaaatgctttcgcttcaaaagtagtatatgacgaaatgaaggacaaagctacagttggtgtgatccatgatgatgctgccaaaaaagtcactgaaattgctgtcccagtgggtgtaattgcaggattaattccttctaccaacccgacatcaacagtcatttacaaagcattaatttcattaaaagctgccaacagcattgttttttcaccacatcccaatgcgttgaaatcgattattgaaacagtggaaattatccaaaaagcggctattgctgcaggggcaccagaaggttgtgtctcggtcatcaaaacgccaaccatgcaagcgaccagcgaattaatgaaaaataaagaaacaaatttaattttagctactggtggaaacgcaatggttaaagccgcgtactcttctggaacaccagcaatcggtgttgggcctggtaatggaccagcctacatcgaacgaagcgcaaatgttcctcatgcagtgaaacaaataatggattcaaaaactttcgataacggtacaatttgtgcatcggaacaatcaattattgttgaaactgtcaaccgtgaagcggtcaaagaagagttaattaagcagggagcgtatttcttaagtccagccgaagccgacaaattagctaaatttattttacgaccaaacggtacaatgaacccgcaaatcgtgggacgttccgttcaacatattgcttcattagttggtttatctattccaaaagatcgccgcttaattgttgccgaagaaacacatgtaggcttgaaatatccattttcaagagaaaaattggcaccgattattgctttctatacagttgaaaactgggaagcagcttgcgcgttatcaattgaaattttgaaaggtgaaggtgcgggtcatacaatgggcattcacacagaaaacaaagaagtcattcgtgaatttggcttaagaaaacccgtctctcgtttgcttgttaacacctctggtacacttggcggcattggtgcttcaactaacttagtgccagcattaacacttggctgtggcgcagttggtggcagctcaacttctgataatattggggttgaaaatctgttcaatttacgtcgtgttgcatatggcgtgcgtgatttagaagagattcgtcaagaatttggtcaaacatcaaccacatctgtggctacttcttgcgaaacaaccaatcaagaagaactagtaaatgccgtggtagctcaagttttagctcgcttaaac

SEQ ID NO: 40 - DNA, 1401 bp, Enterococcus faecalis
atgaatgaattaaacaaaacaccaaaagaaatagtcaaagaactagatcaatatattgttggacagcaagctgccaaaaaatcagtggcggtagctttacgtaaccgctatcgtcgcttgcaattagaagaaaatatgcaacaagatattacgcctaaaaacttactaatgattggaccaacaggtgttggtaaaactgagattgctcgtcgtctcgcaaaaattgtcaatgcgccttttgtaaaagttgaagcaaccaaatttacagaagtaggctatgttggtcgggatgtcgaatcaatggtgcgggatttagtagaaaatgcgatccaaattgttgaaaaacaacaatacagtcgcgtgtatgcgcaagcattaaaaaaggccaatcaacgtttagtcaaagtattagtgcctggaattaaaaaagaacaaaaacaggctggcggtaatcaatttgaacaaatgatgaacatgtttaacatggctcagcaacagcaagaagcacaagaagaagtaacggaagatattcgaacgaatcgccgaacaattttggaacagctggaaaaaggtctattagataatcgtgaagtaacaattgaaattgaagaaccgaagaaaacgatgccagctatgaacaatggcctagaacaaatgggtatcgacttaaatgaaacgttaggcgctctgtcaccaaagaaaaaaatcgaacgtactgtaacggtgaaagaagcacaagaattattagtgaaagaagaatcagcaaaaattgtcaatgacgctgatattcatagtgaagctattcgtttagctgaatcaagcggaattatttttatcgatgagattgataaaatcacctctaaaagtcaacaaaattcgggcgaagtctctcgtgaaggagtacaaagagatattttgccgattgttgaaggctcccaagttaacacgaagtatggtcctttacaaacggatcacattttatttatcgcttcaggtgctttccacttgtcaaaaccaagtgacttgattccagaattacaaggccgcttcccaattcgagttgaattagatgatttaacggcggatgacttcgtaagtatcttaactgagccaaacaatgctttaattaaacaatatgtagcattaattggcacagaaaatgtttcagtcatctttacaaaagaagcaattgaacggttagcacacatcgcttatgatgtaaaccgtgatacagataatattggggcgcgtcgtttacacacaattttagagcgtttattagaagatttattatatgaagcaccagatatgcaaatgggtgaaattacgattaccgaagcatatgtcaatgaaaaattgaatgacattgttcaaaatgaagatttaagtcgttacatctta

SEQ ID NO: 41 - DNA, 564 bp, Enterococcus faecalis
atggcaaaacgaattatcattatgaactttgatattgaaagtaaatcgtaccaagcattttccgaaataaaaaagatgcaggcagaaagacagcttaaaggtgagcaaatggcggttgttacgcatgttaatgatggccagcatcaatttaaaatcaatgattttatcgattttacaggcaacaatcatacatcaaaagatagcatgattgggatgctagtaggcatattaggtggtcctctgggcattctttttggctggtttgctggaagtatgtatggtgcaagcaaagacgccaaagaaattcaagaagcacaaacggtttttgaacatgtgattcaaaagattgatgaaggacaaacgggattgttattaattgcagaagaagaagacaaccgtccgctcaaccaattggttatgtttgacttaggtggcgaaatcacgcggcttgatttagaggaagtccaacaagaaattaacgatgcgaacgaagttgcaaatgaagcgaaacaatcgtggcaagcaaaaaaagaacaacacaaagaagcaacatcgaaagaagaa

SEQ ID NO: 42 - DNA, 999 bp, Enterococcus faecalis
atggaaaaacaaacaattacaatttatgatgttgctagagaggcaaatgtatctatggctactgtttctcgtgttgtcaatggtaatcccaatgtaaaaccagcaacgcgtaaaaaagtcttagaagtgattgatcgcttagattaccgtcctaacgcagtcgcacgtggtttagcaagtaaaaaaacgacaacagtgggtgtcattattccagatgttagtaatgcattttttgcttcattagcacgtggcattgacgacgtagctacaatgtataaatacaatatcattttagctaattcagatggagacgatcaaaaagaagttactgtattaaacaatttacttgccaagcaagtagatgggattatctttatgggtcatcgcattacagatgatattcgtggtgaattttcacgttcaaaaacacctgttgtcttagcaggttcaattgatccagacgaacaagttggtagcgttaatattgattacacagaagcaacgaaagatgcaacagcgactttagcgaaaaatggaaacaaaaaaattgcttttgttagtggtgcattaatcgatccaattaatggtcaaaaccgaatgaaaggctacaaagaagctttagccgaaaatggcttatcttataatgaaggcttagtttttgaatctgaatataaatttaaagcaggcattaatttggctgagcgtgtccgtaatagtggggcaactgctgcctttgttacagatgatgagctagcaattggcttattagatgggatgctagatgctggtgtgaaagttccagaagaatttgaaatcattacaagcaataactcattgcttacagaagtctctcgtccacgtctatcaagtattacacaacctttatatgatatcggtgccgtgtcaatgcgtttattaacaaaactaatgaacaaagaagaaattgaagaaaaaacagttgttttaccttatggaattgatcaaaaaggttcaacaaaa

SEQ ID NO: 43 - DNA, 1152 bp, Enterococcus faecalis
ttgaagaaatacaatgttgattggaattactgggttgtccgctttttatttgtaatggcgctgattgttggctatttattaatcacgaattatcagcactttgtccatagtgtttcgggtttattaggcatcttatccccattcattactgggtttgtgattgcttatttattgagtggaagtcagaaaaaaatcgagggattactagaaagagttcctttaccagtcgttaaaaaagcgaaacacggcttgagcgtactccttttgtacctgattattttgtttatttttgttttgacattaaactatatcgttccgctactcattagtaatttagtagatttagcaaactctttacccactttttatgatcacatggttcagtttgtaatgagtttagaagataaagggattttaaaaacagccgcgattgaaaaatatttaaatagtgtccttaaagatttgtcgccagaacgttttttaaatcaatggacacaagcgttgttttcattaggaacgttgactaaaaatgtttcatcattctttttaaatgcatttttgacgttgattatctcaatatatgcgctggtatttaagcaatctattttgacatttgttgaaaaggctgcccacaaattgctgtctgaaaaagtgtacaagcaaacacaaacttggttaaatacaacgaataaaattttctataaatttatcagctgccaatttcttgatgcttgtataattggcgtttcatcaacgattttgttaagtattttgaatgtgaaatttgctgtgactttggggattttattaggtatttgtaatatgattccttattttggttcgatttttgcgtcaattgttgctggtgtgattacgcttttcacaggtggtgttactcaagcaattacggtgttactagttttattaattttacaacaaattgacggcaatattattggtcctcgaattatgggagatgccctaaatgtcaatccgattttaattattgtttcaatcacgattgggggagcgtacttcggcgtcttagggatgtttttagcagttcctgttgctgcaatcattaaaattattgtctcggagtggctaaatgaatcaaaagaaaatgataagattgtagattctattgaatcc

SEQ ID NO: 44 - DNA, 852 bp, Enterococcus faecalis
atgaaaaagttctccatacgaaaaattagtgctggttttttgtttctgattttagtaactttgatcgccggttttagcttgtctgcaaatgcagaagagtatatcgttcctgccgaaagtcattcacgacaaaaaagatcgttactggaccctgaggacagaagacaagaagtggcagatacaaccgaagcgccttttgcgtcaatcggaagaatcatttcccctgccagtaaaccaggctatatttctttaggaacaggctttgttgttggaaccaatacaattgtcaccaataatcatgtggctgaaagttttaagaatgccaaagtattaaatccgaatgccaaagatgatgcttggttttatccaggtcgagatggcagtgcgacaccatttggcaaattcaaagtgattgatgtagctttttccccgaatgcggatattgcggtagtgactgtcggcaaacaaaacgatcgtccagatggcccagagttgggagaaattttaacgccatttgttttgaaaaagtttgaatcttcagatacccatgtcacaatatcaggctatccaggtgagaaaaaccacacacaatggtctcatgaaaatgatttgtttacatctaactttacagacttagaaaatccattactattttatgatatcgatacaaccggcggtcaatctggttcaccaatctataatgatcaggttgaagtagttggtgttcattccaatggcggcattaagcaaacaggaaatcatggtcaaagactaaatgaagtgaattataactttattgttaatcgagtgaatgaagaagaaaataaacgtttatccgctgtgccagcagcg

SEQ ID NO: 45 - DNA, 1956 bp, Enterococcus faecalis
atgaaaagaaagaaaatcaagaatcaactacttgttttaacaagtattctcgttcttctgagtttggaagtcgctccagttgttacgttggctgcagaattaccaagtagctcgctacaaacagctctgtcctcggaaacgacaattacttcggaagaaaaagtaaccgaaacaaccgaaacaactgttgctacatcgacaacgtccactagtagttcgtcatctgaatcaagtagttctaccgatacgactaccgaatcaacgagtcagtcaacgacagaaacgacaaccacaaatactagttctgaaacaaaaaaagaacctacagagccaacggtatcatcagaaatcacgcagcctgttgaacaatcgcaaccaccacaagttcctgtgaccaagcaagaacccgaagaacctattcaagttcctgaagccaacaataactttgttgaagaaaatcaggctgtatcgttaaatccgtccctcaaagtagatgaaatagcttcttcaaatttaaaaggctacgaacttccactgttgtcgtcttttggcgaaaagaaacgggcagtcgtggtcgctgaagcattaagacacgttgggaaaacaaaaaaagaatttaatttgacggagcaagcattgaccagtagtttccttgcccaaaaaatttaccaacaattatttaaaatagacattggcagtacgccgcaagaacaaatgacatttggtaaagttcgttctatagaggaggcagaacctggtgatctgattttttggcaaacagctgaaggaaaaacgcttcaaaatggtgtttatcttggccaaggaaaatatttaattgccgcagcggaatcggattctaaagagaaaccagaagtaatcgctcagttagagaatatctatactgccaaacaacaaccagactcaaaagaggaaaaacgcttggtagtgactaatccttttaaggagttcatattaacggagtatggcaaagaagttttagcaacatatggtgcgtcatttgaaatgcagaagtcagaacaaaccacagcgtttattaaaaaaattggtgagacagccagagaacttggcgaaaaatacgatgtttttgcatcagtaatgatagctcaggctattttagaaagtggctctggcgaaagtcaactagccaaagaaccttattataatctctttggcgtgaaaggttcgttccaaggaaatagtgttagcttttcaacaaaagaggctgatcagaggggccaactttatacaatttccgctgggtttcgcgattacggtggctataatgactcactgcaagattatgttcaattactccgacaagggattgacggaaatcaagatttttataaaccagcgtggcgttcggaagccaaaaactaccttcaagcaacgcgttttttaacaggtaaatatgcaacagacaagcaatacgataataaattaaattcgttaattgcggtttataacttaacccaatttgatttaccaaaaacagtggacggtttgattatccaatctaaaaataagctgtcggaagcggaacagcaacaaatgcattttccagtctatgatgggatcaattataatcgaagtggtagctatcccgtgggccaatgtacgtggtatgtctataatcgtttcaaacagttgggcacttctgtggatgaatttatgggaaatggcagtgactggggaagaaaaggacgtgcattaggctatcaagttagttcattgcctaaagctggtcgtgcgattagtttccaaccaggagttgctggcgcagataatcaatatggacatgttgcttttgttgaagcggtcacttctgatggaatcattatttctgaaagcaatgtcatcaatgatcaaacgatttcgtatcgtgtcttacctaatgtaattgcttatagtagtggcgtgacctacattggcgct

SEQ ID NO: 46 - DNA, 561 bp, Enterococcus faecalis
gtggatgcagaagcttatttaggtcctgatgatgaggcggcccatagctttggcttgagaaaaacgccacgcttacaagccatgtatgacaaaccaggtacgatttatttatatactatgcacacgcatttaattttaaatatggtgacacaagaacaaggcaaaccacaaggggtgatgatccgcgcgattgaacctgttgaaggtgtcgacaaaatgattgaaaatcgccaaggacgtcaaggcgtggaattgaccaatggaccaggtaaattagttgcagccttaggaattgataagcaattatatgggcagtcgattttttctagttcgttacggctcgtgccagaaaaacgaaaatttccgaaaaaaattgaggcactaccacgaattgggattcccaataaaggtcgttggacagagttgcctttaagatacgtcgtggctggcaatccatatatttctaaacaaaaaagaacagcagtagaccaaatagattttggctggaaggatgaagaaaatgaaaaaagcaacaatgctcacatacttagaggaacaact

SEQ ID NO: 47 - DNA, 846 bp, Enterococcus faecalis
atggcaaaaaagaaaaatgtaagtgtcatttctgtagagaagccaacgtggttcccactaacagacgaaacgggcgcttttccagtttacggagcgccaattacaatcggtactgctgtaagtatcaaaccagatgttacaacagaaacaacgcctgactatggcgatagtgtagttcaagatcagtatgttgcatttggtggtgcagaagttactttagaaacaaacggctaccaaaatgaagttttagctgaaattacagggggaaaaaaattaaagggtggcgtattgcggtctgcggatgatattgcatcagatggcgcatttgcttatcgtcgccgaaaatcgaacggtaaatatcgctatacgattttctataaaggaaaatttgctttaacatctgatgaaacatctacattagaaggaagttcagtatcttatacccatccagaatggacggggtctttcgttgatgttccagggttgggttatatgtattccgtggatgaagacgatgaaggtgttgacttagagatgattaaaaactggtttactgaggtaatggatccacgtaaagaaaatactactgctgttactggtgtaactttagaccaaacagagttaaatttaaaagttggccaaacagcaaccttaacaccgacaattacaccagataacgcctcaaataaaaaatatcagttccgttcagaaagtgaggctattggaactgtaacaccaattcaagggaaggttactgctgtaggagaagggacaacggaaatcgtagtcacaacagaagatggtaactttaccgcaaaatgtacattaaatgtaacaacagcagat

SEQ ID NO: 48 - DNA, 2331 bp, Enterococcus faecalis
atgtttcttggcctgatttttattttattcggtgtctttggactctttcgcttagggtttttaggcacgttattagcgaattgtttacgcttagttgtaggtaatacctttccatttgcagcgattttactaatcctgtatggcttattagtcatgatttatgggaaagattttccgttaaaaagagggcgccctatttttggggctgttctgatttatattagtgttttgttatttttccatgcctttatgtttcgaaatgttagtggcagtcaaccagatattttaggtaacacttgggaatttttgcaaagcgatctaaaagctaaccaagtgacgcaaaacgtagggggcggtatgattggcgcactgctttatcaaggaacgtactttttggtggcacaatttggtagctatttaattgccaccttgctactgttagcgggtattttcttgatgagtatgtgggattttcagcaaattgttgatcatttccaaagtattcaagatcgcctaagtcatgtttcggcaaaatcacaggcgcgacaagaagaaaaagaggcgaagcgagcagcgaagaaagaagccaaagctgcagaacgccaagcaaaaattgaagccgctgcccaacaaaaattacaagagcgggaacgcatggaacaagcggcagccgagcgcttaacaaaaacacctgttgaaacccaccaaccaatggtggaagaaccggccgcaccaacgcctgttcaaattgattcgtttcaacagcaaaatcaggcgatgcctgtaccaccaattgcagcaacaaaaccgcaacgagagcaggaagaagaggcggcagatgaagctggtgttctcgaatttgaaatttctgaagaagcggaagatcgtgattatcaactaccaccaactgatttgttagatacaattcaagcaacggatcaaagtggtgaatatgaaaaaatcgaaaaaaatattggcgtcttagaacaaaccttcaagagttttggtgttgatgctaaagtagtcaaagctagtttaggaccatctgtcacaaaatttgaagttcaacccgctgttggggtaaaagttagcaaaattgttaacttgacggatgacattgctttagcgcttgcggccaaagacgttcgtatggaggctccgattcctgggaaatcactaatcgggattgaagttcctaatagtgcaattagtacagtatcctttagagatattgttgaggcacaaccaagtcatccagataaactattagaagtacctttaggtcgagatatttcagggatggttcaaactgcagatctatcaaaaatgccgcatttattaattgcgggatcgacagggagtgggaaatcggttgctatcaatggcatcatcacaggtattttgatgcaagcgaaacctcatgaagtaaaattaatgatgattgacccgaaaatggtagaattgaatgtgtataacgggattcctcatttattaacgccagtggttactaatccgagaaaagcggcccaagccctgcaaaaagtagttcaagaaatggaatttcgttatgaaaaatttgcagcaacaggcgtccgaaatatcactggttacaatcaactaattcaacagaaaaatgcggaagatggcgaaaatcgtccaattctaccatttattgttgtcattgttgatgagttagctgatttaatgatggtggcaagtaacgaagtagaagatgcgattatccgtttagcccaaatggcacgggcagcaggtattcatatgattttagcgacacaacggccaagtgtggatgtcattacaggaatcatcaaagcaaatgtcccttctcgaatggcttttgcggtctcaagtgggacagactcgcgtaccattattgataccaacggggcggagaaactattaggtcgaggcgatatgctcttcttaccaatgggagaaaataaaccaattcgtatccaaggggcctttatctctgatcaagaagtcgaacgagtggttgcgtttgtaacggatcaacaagaagctgaatatcaagaaagcatgatgccaacagatgaaccgaccacttcaggcggtggcgaagctcctcaagatgagttgtttgaagaagcgaaaaacttggtggttgaaatgcaaacagctagtatttcattgctacaaagacgttttagaattggctataatcgtgcggctcgcttagtagatgaattggaagcacacggagttattggaccatcagaaggtagcaaaccaagaaaagtctttctacaagcggaatcagaagaggcagcaaccgagacgccagaacaa

SEQ ID NO: 49 - DNA, 747 bp, Enterococcus faecalis
atgagaaaaagctttaacttagctgttcaagcgttaaccgttcaatatcaaggacggaccgctttaaataatatccacgttactattccctccggtaaaattactggaattatcggaccaaatggtgctggaaagtcaacatttattaaagggttattaggcttgattaaaacaaaggaacgtgatgttttgttaaataatcaagcgattgaccaacaaaaaacaaccattgcctatgtagaacaacgtagcgccttggatcttagtttcccaattagcgtttttgaaacggtcttgctaggaacctatccaaacttgggactattaaaacgcccaggaaagaaagaaaagcaagcagccatggctgcattaaaaatggtgcaattagaagactatgcgcaacgccagattggcgaactttctggtggccaattacaacgtgtgtttatcgcccgtgttttggcccaaggtgctgaggtgatttttttagatgaacctttcgtcggcattgatatgtctagtgaaaaagtgattatggatattcttaaatcattaaaaaatcaaggtaaaatgattatcattgttcaccatgatttgcacaaagtgtcccactattttgatgaattaatcgttttgaaaaaccggctaattgctgcgggtcctgttgaacaaacatttactgcagaaacgctccaagaagcatacggtgatttgttaggtgatttattaatacagggggttgcaaaa

SEQ ID NO: 50 - DNA, 531 bp, Enterococcus faecalis
atgattggattagaattgacttttacagtccctcaagcagatgaagtcattcggtcattagttgaaacatatcatgacgagaaagatatcgtgattggcgcgggcacggtgttagatgctgtgacggctcgcctagctataatggccggagccgaatttattgtaagccctagctttaatcgggagacagctgaaatttgtaacttgtatcaagttccttacttgccaggatgtatgacaattactgagatgcagacagctttgaagagcggagtagatatcgtgaagttatttccgggaagtacctatggtccgagtattatctctgcattccaagcacctttgccgtacttgaatattatgcccacaggcggtgttagtctggataatatggcgtcatggtttgaggcgggtgtgacggcagtgggtgttggcggaaacttattagctcacgctaaaactggtgagtttggtaaagtaacggctttggcaaaacaatatatggccaaatttagagaaataaaggaaaac

SEQ ID NO: 51 - DNA, 948 bp, Enterococcus faecalis
ttggcaggcgtaaccaaagagcagattgcaaaagcaaaggaatgggatctgctctcttatttgcaggcctatgagccgcaggaactgaaaaaaagcggcccccgcgaatactgcaccagaacccatgacagcttaaaaatctccaacgggaaatggtgctggaacagccggggcatcggtgggcgcacggcccttgattatctgatcaaggtgcgcggcatggactttgtaggcgcggtggaaaccctgtgcggctactgtgcgccaccgcccgaaaaagcgccgcccataaaagaaaaacagccaaagcccttccgactgccccaggccagccgatgtgcatccgctgttgtgggctatttgcaggatcgcggcattgacccggaactgcttggcgtgtgcatggaagccgggattttatacgagagctgcaaataccagaactgcgtctttgttgggcgcgacacagcagggaacgcccgcgccgccagcctgcgggggacgcgggacggcttccgcatggatgtggagggaagcgacaagcggtacagcttctgtctgccggcaggcaaggcagactgcccccggctggcggtggcggaaagccctattgacgcgctctccctcgccacattagtaaagctgtccggcggcgaaccacgggacagccattatttatccctgggcggaaccggcccccgcgccctgatacagtttcttcacgaccacccccacgttacccaagtcagtctgtgcctcgacaatgacaaggccggcttggagggcatggaacggctcacccaggaaatccagaacgatgcggaactttccaggcgggtgaagctggtttaccccaacccgccgaagcagggcaaggactataacgagtttctctgcacccacgttaaagcggtacggacggcacagcggcagcgggacgcggcgcgg

SEQ ID NO: 52 - DNA, 336 bp, Enterococcus faecalis
gtgaggataaaggaggggcgcacggtggggctgttcaccaaagtttccccggaagaaaaggcggcgattgaccgcaaaatggaattgctgggaacctccaacctgcgggcttacctacgcaagatggcggtggacggctacatcgtgcagcttgacatgggcgcggtgctggaactggtaaaattgctgcgttccgtttccagcaacgtcaaccagatcgcccgccggtgcaacagcacccacaacctctatgagcaggatgtggaggacttgcggcagggctactctgaaatctggcagggcgtgaacgacctgctgaagaaatttgaagcactg

SEQ ID NO: 53 - DNA, 9519 bp, Enterococcus faecalis
atggcgaataagctacaaaccgtgtcgcagcttgcagaccagaccgccaaggccgtcacgcggaacgcggagggctggaaaagctatctgaccactgcatcgcggctttataaatactcgtttgacgaacagcttctgatttacgcccagcggccggacgccaccgcctgcgccagcatggaattatggaatgaggatatgcggcgctgggtcaaggccggctccaagggcatcgccctgatcaaaaaggacggcatccgcccacggctgacctatgtgttcgatgtggcggatacccgcccggtgcggggcgcgaaaatgccctatctgtgggaaatgaaagacggacaccatgccgccgtcatggatacactggcacggcgttacggggaaacggaaaagaaggacatcggatctgcgctgatggagcaggcgaaacacgccgtagaggaagtgtaccgggaacacctttctgaccttgcctatgacgcccaggacagtcttttggaggggctggacgatttcaacctggaagtgcgcttccgaaatctcctgaccgccagcgtccagtatacgctcctttcccgctgcggcttaaaccccgccgattacctggaggacgaagattttgacggcatccatgaattttccacccccgccgtcctccaccacttaggcagcgccgccagcgaagtgtccatgaatatgctgttggaggtcaagaaagcaatccggcaggcggaaaaagaaaaggcacagaaccggcagaaaatcccgaaaaatcccgaaaaaccacttgcaaaagaaccggtgatcggttatactaaagtcaaggaacagtttaacacattaaaacgcgaaagcgaagaaaggagcatacaaaatggcagaactggcatacaagaggacgggcgactacctgattcccgacttggtgatggacggggaggacgagatggaggaaatgccgctgggcaagtacggcaggctgcggcagacctttcttcaggaacaccacaaggggacatacacctcgatgctgctgaccgggcggctggaaccccacctgcgggagatcgaccggcaggcgcaggaacaggcagaccggatcgtggcggaattaaagaaacagaacggcgtggacgaggggatgaaagcccgcgaccagatgggatgggtgcaggcagtcaacctgtttctcgcccaggcggaggaaaccgtactgaacgagatcgtttacaagtaaatcaggagaaccagcaggaagcggcgggcgaacagtccgccgtttctgcgtctgaaaagccggcatttacacagttttctttattccccactgtggaacagcagattgaaactattgctcaggcacagaaaaccgagcaggaactgcgccccgccgtttcctccggcaaggtcacggatgcggtcattggccgcgccctcacaagcggcggcaacgagccggacagcatcctgcgtatcgtcgcttttttccagaaagaccctacggagcagtctgccgccgattttctgcaaaaggaatacggcagcggcggcaaggggcttaaaattgccgggcatgagtattcgctgtggttcagccatagcggtatccacatcgcgccggggcgctctgccgggggcggctcccttgtcacctggaagcaggcggcggcacagatccggcagcttttgaacagcggccagtttgccagccaggacaaaatcgacgcggcccgtgacaatgaatttcgggaattgtcggaaaaactgtggtttctgcggcagaatttcagcgaggaagcaaaggaaaagggcttgctgcccaccattgacgcgctgtacggtggtttcccggacagcacggctaaaattgccgcgctcctgaaagacccggcagaacgagccaaaattgcacaggaagtccggcagtttgccatctcccatcaggagaacccgaatctgctgcgcttccgccagcggcccgcgccctccgaactgtttacccgcctgaccgatatggataagccggtgacggcatttcatggggtggagggctttgcgcctgcccgtggagcttttgtcaccgaggacgagattacccggatgttcactggcggctctggcgtttccgaggggaaattccgtatttacgcctactttatgcaggggcatgatgccaaagagtgcatcgaatttctgaaaaacgaatacggcattggcgggcatggctacattggctatgatgaatggcacgacggcaaaggcatcaagctgtcccgcgccgacgatttttccggtggcaattatgatacggttacgctgaactggaagcaggtacaaaagcggattgccggactgattaaaacggatcggtatctgaaccgcagggaaaaggcatatctgccggaatatgaaaaaatgcagcttgctcggagtctatataccttccaatactacgaccccaacgatgccagcaagacaatcccccacgactgggatgttgacgcggcaaaaaaggtattccgcccgctgttagatgacccggaacaatgcgcggcgcactatgaaaaaatggtgaaagccctggcaatggtatccccggatgagcgcgcctattccctgatggagccgacgcttcaaaaaatgggcgcatacctgcggggcgaatactccttattcacccctctgcctgatgccgtcttgcaggaggaacggcagaaaaagcagaaacagaaacagaaggaaaggcaggattccgccagacaaacggctgaacctgcaaccggccttgctgctgcggcaaaagccctttcccgcaagaaacagcctgccccacgggaggatgcagacgggcagcttactttagatatgttcgggctttcgtccgaaccagaacagccagccgcaactcctgaaccggagccggaactttcgcaggcagaaaccggcgcatctgaaacggccgtccctatcgcatcaaagccggaaccaccgcaggaaacgccgaacataccagaaggggctgcgcccataatggccgaaagccccgctgaccgctatgatttaggctatggccatatggggaacggcctgaccgtctggaaccgtctggaggaagaacacggcgactacaaaacagttgcccatatcgcccctgaccgtaccgtgactttttacgacgcggatatgccggaggaaatcagggaaaaaattcaaaaggttgccgctgccactgaaatgtccatttctgccacccaggacacgccagtattttccaccccgccccaggagccggaacgggtgcagcctgggaactcggagccagagccggaaaaggtgcaggacgcgcccgctgcggtcaatccagagccggaaaccggggacagcaatattgtaccatcccccgcgcaaaaggcgggcgcagaacccaccggcacaggttcgccgcagacccaggaagccccaaaaacagccgccgcagacggtctgaaccttacgcccaacgtggaggaatacctgaacctgaaagcccaataccctgacaaactggtaggcgtccgggtagggaaaaccatgctgttttacggcacagacgcagaggaagccgcccctgcgctgggaacgaaaaccatcacccgcgatattcccgacctggggatggtgtccatcaccggagccaatggctggcagtccgtcttaaaaaagctgctggaacatggaaaaagcgtggtgctggcgcggcctgacacggaacgcggcggcgatgccccctatgaaatcatcaaggaacgcagcgcggcggattatatccctgtcggcatggaactgaccattgacgggcggctgatgaagattgacagcgtggactataacgccggaaccgtcagcctgcaagatatggaactgcggggctggtatcccattttccgcagtgaaagcatcccctttgtgcggcagtttgtagaggaagtccagcaggagcattttacagcggaacccatgcaggagccggaacgccccgaaacctccgatttagatacggcaaaacagctaattgaacagtttgcctacgccgaatatggcagcgatgatgtggatttttccgatttggagcatatcgggattgcctatggcacgaccgaggacggcggtttagaagtccaggtggacgtaaacctgctggatttctccatcagccagtccgtagacgggaaatgcgtggaaacacggcagtatggcagcctgcgggaactgattgatatggaacttgctttccttgactatgatatgctggtttccgtggaaccggatattgaagaacggttaaaagccgaactgaaccagcggatcaggtggtcagaaatggcaggtgccagagagggcgtggagccaacagagccggaaatttttccagagaaggacgtttctccagaacaggaagcaccgccggaactggtggagattgacggcgggcagattacggaaaccccggcgcaaagacagacccgccgccgcgcccaggaggaagtggacagccgggtattccccagcgagattattttacagccgctccgtctggagccggaacgccacaacttccgcatcaccgatgaaaatttaggcgcaggcggcgaaaagaccaagtaccagtacaacgtggaagccatccgcaccctgaaacagattgaagccgaaaaccgccttgccacaccagaagaacaggccattttatcccgttatgtgggctggggcggcatttcccacgcctttgagccaaacgacccaaaatgggcaaaggaatacgccgaactgaaagaactgctcacccctggggagtaccagtctgcacaaagcacggttctcaacgcccactacaccagccccaccgttatccaggcaatctacaatgcggtggaacagatggactttacgccggggacggttttggagccgtctatgggcatcgggaactttttcgggatgctgcccgaaaaactggcggcagcaaagttatatggtgtggaactggacgacctgaccgggcgcatcgccagacagctataccaaaaggcggatataacggtagacggatttgagcgcaccgaccacccggacgatttctttgaccttgcggtgggcaacgtcccctttggcagctatcaggtgcatgacaagcggtacgaccgtcaaaacctgatgattcacgactatttcatcaccaaaacgctggacaaggtgcgtcccggcggcattgtggcctttatcaccaccaaaggcacaatggacaagaaaaacagcaaggcgcgggaggcgctggcacaaaaagccgatttattgggtgcagtccgcctgcccagcaatgcgttcaaggccaacgccggaaccgaagtcacaacggacatcctctttttccagaagcgcgaccgcatcccggaaaaactcccggaatgggtggaggtcgggcagacagaggacggcatccccctgaaccgctactttttagaccacccggaaatggtgctggggacaatgacaatgggacgcagtatgtacggcaatgaaactgaaaccgcctgccagcccatccccggcgcagacctttccgggcagcttgcagaagctatccggcatatcgcaccgcctgaccgggaactgttagaagtggattccgggcaagacggcgaggaactggaaagcatccccgccgaccccactgtacgcaatttcagttacaccctatccaatgataagctgtacttccgggaaaactcccgcatgacccaggccgtccttggcaaaacccccacggagcgcgtcaggggcatgatcggcatccgggacagcgcccgccgcctgatcgacttacagcttgccggcgcagacgacacagaaatccagtccgagcaggcaaaattaaaccggctctatgatgcgttcagcgcaaagtacgggcttcttaacagcactggcaacaagctggcctttgagcaggattcctcctatccgctgctctgctctcttgaaatcatcaacgaggaggggaagctggagcgtaaagcggatatgttcaccaggcgcaccatccagacccaccgcgccgttaccagcgtggacacggctgtggaggcgctggcggtatctatcggtgaaaaagcctgcgtggatttgggctatatggcatccctcatgggcggccctgaaaaaatcccgcagattgtggaggacttaaaaggcatcatcttcaaaaaccccgccaccggcccctttgacctggaggacggcggcgcacactggcatcagggctggcagacggcggacgaatacctttccggcaacgtccgggccaagttagcgattgcccgcgccgccgctgaggaaaacccgcagtttgccatcaatgccgaaaagctggaacaggtgcagcccaaagacctgacggcatctgaaatcagcgtccgtatcggcgcgtcttggattgacccggagtattaccagcaattcatgtttgaactgctgcatacacctgtgtatttacaggacagaaaaatcaagctgcaatattcccctaccaccggcgaatggaacgtgcagggaaaaagcacagacaaccgggataacgtgcgcgtctatgctacttacggcaccaagcgcatcaacgcttatgaaatctttgagcagaccttaaaccagcgggatgtacggatatttgataagacagaagtggacggaaaggaggtgcgcgtcctcaacgaaaagcagaccgccattgcccagcagaagcaggaagccatgtgcgaaacgttcaaggactggattttcaaagacccggaacgtcgggaaaccctttgcaggcggtacaacgagaaattcaactgcatccgtccacgcgaatatgacggttcccatatccgttttgctgggatgaacccggaaatctccctgcgtacccaccaagagaacgccgtggcgcggatgctctatgggaaaaactcgctgcttgcccactgtgtcggcgcgggcaagacctttgaaatgattgccgccgcaatggagggcaagcggctgggtctgaaccagaaatccctattcgtcgttcccaaccacctgacggaacaatggggcggcgattttttgcgcctgtaccccggcgcaaaggtgctggttgccacgaaacgggactttgagcctgcccgccgcaagaaattctgcgcccggatcgccaccggcgactatgacgcgataattatcggacactcacagtttgaaaaaatccccctctccccggaacggcagaaagccgtcattaaggggcagattgatgaaatcgtcaccgccattgccgaagcaaaggcggaggacggcgagcgctacaccatcaagcagatggagaaaacaaagaaaaacctggaagccaagctgcaaaagctggcggacggaaagaaaaaagacagtgttgttacctttgaggaattgggcgttgaccgtctgtttgtggacgaggcgcacggctttaagaacttgtttttacacacaaaaatgcggaatgtggcggggattgcccagacggacgcgcagaaatccagcgatatgtttgccaagtgccgctacatggacgaaatcaccggcgggcgcggcatcgtgttcgctaccggaaccccggtgagtaactcaatggtagaattgtataccatgatgcgctacctccagtttgacaccctggagcagaacggccaccgccatttcgacgcatgggcggcagactttggcgaaaaggtcacggcgatggaattaaagccggagggcagcggcttccgctccaagacccggtttgcgaaattctataacctgccggaacttatttctatttggaaagaagccgccgacatccagaccgccgatatgctgaatctccccgtgccaaaggcggaatatatcaccgtcaccacggaacccagcggattccagaaagaaatggtggaggaacttggcgagcgtgcggaaagtgtgcgcggcgggcaggttgacccccatatcgacaatatgctgcggattacttcggacgggcgcaagctggcgctggatcagcggctgcaaaatccgctcctgcccgacgacccggacagcaaggtcaacgcctgcgtgaaaaatatcgtgcaggaatggcaggccagcacggagattttaggaacacaattagtgttttgcgacctcagcacacccaagggggacggctcattcaatgtctatgatgacatcaaggaaaagctgattgccaaaggcatccccgaagcggaaatcgcctttatccacgacgccaacacggaaacccaaaaggcagaactgttcgccaaggtgcggcgggggcaggtgcgtgtcttaatcggctccacggcaaaaatgggcgcaggcacgaatgtgcagaaccgcattgtcgcgtcccatgacctggattgcccctggcgtcctgccgatttggaacagcgggcgggccgatctctgcgccagggcaacatgaatgcgtcggtgaaaatgttcaagtatgtcaccaagggtacattcgacgcttacaactgggggctggtggaaaacaaacagaaattcatcggtcagatcatgacctctaaaagccctgcccgctctgccgaggatgtggacgccactgccctttcctatgctgaggtcaaggcccttgccaccggcgacgaccgtatccgcgaaaaaatggatttggatgtgcaggtttccaagctgaaaatgctcaaagccaaccacacctcccaacagtacgaaatgcaggacaaagcgctgaaatactacccgcagaaaatcgcggaaaccaagctgttaatcgaagcgctgacggcagatttgccaaccgtgcaggcccacccggtcaaggacgatgcgttttccatgactgtcatggggcagacctacacggagcgcaaggcggcgggcgaagcggtgattaaagcgtgtatgctgatggacgacccggaaaaaaccgtggatttgggcgagtttcgcggctttcccatgcagctaaggtgtgacggcagcaaattccgcgtcaccatgaagcagaacctgacctattccgccgaactgtctgacgatgcggtgggcaacgtcacccgtattaacaatgcgctggaaagcctgacggagcggttggacgcacaaaaagcacggcttgccacactggaaagcgaactggaaaacgccaaagaagaagccgaccggccattcccaaaagaagaagaactgcgggaaaaatccgcccgcttaaaccagcttaaccgggaactgtccaggccggacaaaaaggaggatgagcaggaggttgaagaaagccctgatttggaggacgccggaaaacccgcgccggttgtgccgatgcccgctgtggcggctggctataaaccctctatccgtcaggcaatccgtaactatgaaccgcccacgccggtacattccggcatggagcgcaccccgcgaaaggaggcggtgctg

SEQ ID NO: 54 - DNA, 1884 bp, Enterococcus faecalis
atgcctgtgttgacttcggggcagcaagaaaggaaaagcaaacagagaaaaatccgcaactcagagtattacgacatggaaggtacttttgacaggctgtatgcagaaagtaagaaagataaaaccttcaaccatctgatggaaatcatcgagagtgaagaaaatatcaagcttgcatacagaacgataaagaaaaatacaggaagtgatacttcgggagtggacaaaaggacgatagccgaccttgcaaagttaagcgaggaagaatacgtccgtctcatacggaaacaattcagtaattatcatccaggacccgtaaggcgagtggagataccaaagcccaatggaaagaccagacctctgggaattccaactatcgtggatcggatcgtacagcaatgtattttgcaggtcatggagccgatatgtgaagcaaaattcagtgagaactccaacgggttccgcccgaaccgttccgctgagactgctattgcacaatgcatgaggctgatacaggtacagcatctgtaccatgtggttgacctcgatattaaaggcttctttgacaatatcagccatacaaagctgattcgtcagatatgggcattgggaatccgggacaaaaagctgttatgcattataaaagagatgctgaaagcacctgttgttctgccaaatggagagaaaacatatcccgcacggggtaccccgcaaggcggtattttgtcgccattgcttgcaaacatcgtattgaatgaactggattggtggattgcctcacaatgggaggagatgccaacaaaaacaaaattcaaaacaaggagcaatgcgcagggaacagagattaagagccacgcctacagggctctgcgccggagcagattaaaagagatgcatgcagttcggtacgcagatgattttaaaattttctgcgcaacacatgaggatgctgtcagagcatataaggcaacagagttatggctaaaggacaggctggggctggaaatcagccctgacaaatccaaagtagttaatctcaaaagacagtattctgattttctcgggttcaagctgaaagtccgtaaaaagggtaagaaatatgtggttcggtctcatatgagcgataaagcatacaaaaaggcgcatgaaaaagtctcggaagaagtaaagaaactggcttattcgtcagatgataatgctcagttcatgcagcttcagaaatataactctgtagttgccggacttcatgaatactattgtatttctacagaagtatctcatgacttcagcagacttgccttcagtatcaacaaacagctcagaaacagactgaaaggcgacttatccaaaaagggacagctcagaaatgggttcattaaagaaaagtatggagcaagcagacagatgaggttccttcatggacgtccggtggttccactgggatatgtccagtcaaagaatgcccagcataaaaggaaatccatcaataaatatacggtcaaaggtcgggaacagattcataagaatcttgcaatcgacacagctacaatgttatggctgatgagaaatcctgtaaagggcagaaccattgaatatgcggataaccgtatttctttgtatgcggcacagtatggtaaatgtgcagtgacaggaattccgatgaattcccacgatattcactgccaccataaagtaccggtaagcaatggcggttcggatgaatacgcaaatcttattcttgtcagcaaagcggttcatatccttatccatgcttcttcagaacctacgattgagaagtacctgaaatccttaaatcttgacaataaacaaatagaaaagcttaacaaacttcgttctatggcagaaatgccacctattattctt

SEQ ID NO: 55 - DNA, 4353 bp, Enterococcus faecalis
gtgacagaaaaagcacgcgatttatttgataaactgatgacgcaaattcagttagatgacacagcgaaagaacatcccttaattcaaaatggccggattgacaaggtcattgttcaccaacaaagtcgcttatgggaatttcatttaagttttgatgaattgatgccagtgatgctatatcaaacatttatgcaacaattggaactagcttttcaacaaattgcgcaggtttccgttcaaataaccacaaatcagacaacatttacagaggaacaattaacggattattggcaattggccttgttaaatagtcaatgcaatacgccgttagttcagaaagtcttaaaaacacagacaccacaatttgaagatcggaaaattatcttacctgttgataatgaagcagttattccttatttgaagcaacaatatttaccaattattgaggaactttatttctcttacgggtttcctaaatttcatattgaaccaaaaatggatcaacagcaagctgcagaagtgctgaaaaaatttgaagagcaaaaattagaacaagccgcagcctttcaacaacaagctgctgaatcgcttgttaaacatgaacaaatgaaaaaagaaaaacaacaacaagcgcctgcgtttgatggtccaattcgtttaggtcggaatattcccaatgatgaacccattatgccaatgggaaacatactggaagaagaacgtcggataacgattgaaggctttatttttgataaagaagtgcgtgaattgcgttctaaacgaaaaattttaattttgaaaattactgattatacttcctctttcgtggtgaagaaattttcgaatggggaaaaagatgaacaagtttttgatgcgattcaaccgcaaagttggattcgtgttcgtggtagtgtacaagaagataccttcatgcgtgatttagtcatgaatgctcaagatttgatggaagtcgcccatgcgccaagaaaagactacgcgccagaaggtgaaaaacgtgtagaattacacatgcatagtaacatgagtacaatggatgcgaccaataaagtcggtgacttggtggcgcaagcggggaaatggggtcataaggccatcgcaattacggatcatggcggcgcccaagcgtttcctgatgcccatgctgcaggtaaaaaagcaggcgttaaaattttatacggcgtggaagccaatattgttgatgatggtgtacccattgcttacaacgaagaacatattgaattaacagatgctacctatgtggtctttgacgtggaaacaacggggctttccgctgtttatgatacaattattgaattggccgctgtcaaaatgcacaaaggaaatgtcattgagacttttgagcaatttattgatcctggccatccattatctcaaacaacgatcaatttaactgggattacagatgaaatggtgcgcggttcaaaatccgaagaagaagttttacgcatgtttaaagagttttcagaaggaactattttagtggcccacaacgcttcttttgatatggggttcttaaatacaagttatggcaaacatggaatacctgaagcggctaatcccgtcatcgatacattagaattatccagattcttgtatccacatttcaaaagccatcgtctaaataccttatcgaaaaaatttggcgtcaacttagaacaacatcaccgcgccatctatgactcggaatcaacaggtcatttgtgctggattttcttaaaagaagcgaaagagaatcatgatatgcatttccatgatgatttgaatcgtcatattggcgaaggagactcatacaaacgagctcgacctttccatgcaacgattttagcaacaactcaagcaggattaaaaaatctttttaaattgatttccatgtccaatgtagattattttttccgagtaccacggattcctcgttcgcaattatcgaagttaagagaaggacttttaatcggttccgcatgttcaaacggcgaaatttttgaagcaatgatgcaaaaaggtgtcgaagaagcaaaaaatcgtgccaaattctacgattatattgaagttatgcccaaaccagtttacgcgccattaattgaacaagaattggtgaaaaatgaagcagatttggaagaaattattagtaatctggtgaaaatcggtgacgaacttggtaagctggttgtcgccactggaaatgttcattatttaaatgaagaagatgccatctatcggaaaattttagtcgggtctatgggcggcgctaatccgttaaatcgccatagtttaccaaaggttcatttcagaaccaccgatgaaatgttaacggaatttcaatttttaggacaagacatcgctaagcgaattgtagtagaaaatcccaacaaagtcgctgatttatgtgaagaagttattccagtaaaagacgatttgtatacgccgaaaattcctgggtctgaacaagagatcactgatttaagctacaatcgtgcgcgcgaattgtatggcgatcctttaccagaaattgtcgaaaaacggttagaaaaggaactgaattcgattaacgggaatggtttctcggtcatttatttaatttctcaaaaactggtgcataaaagtaatgaagatggctatttagttggttcacggggctctgtcggttcgagttttgttgcgacaatgacagggattactgaagtaaatcctttagcgccacattattattgtcctgagtgtcaatattctgagttctatgaagatggttcctatggttcagggtttgatatgcctgaaaaagcctgtccaaaatgtggcgctcgattgtttaaagatggtcacgatattccttttgaaacgttcttagggttccatggcgacaaagttcccgatatcgatttgaacttttctggcgattatcaagccgaagcccataactacacgaaagttctttttggtgaagaatatgtctaccgggcaggaaccattggtacagtagccgacaaaacagcgtatggctttgttaaaggatatgaaagagatcataatttacatttgcgtggtgctgaaattgatcgcttagccaaaggttcaacaggggttaaacggacgactgggcagcatcccggcggtattattgtaattcctgattacatggatgtttatgactttacgccaattcaataccctgctgatgatcaagaggcagaatggaaaacgacgcactttgatttccattccattcacgataatattttaaaacttgatattctaggacatgatgatccgaccgtgattcggatgttacaagatttatctgggattgagccaaaaaccatcccaacagacgatccagaagtgatgcgtatttttgaaggacctgatgttctaggtgtggatgcagagcaaatttattctaaaacaggaactttaggaattcctgaatttgggacacgtttcgttcgaggtatgttagaacagacccatccatcaacttttgcagaattacttcaaatttctggactgtctcacggaaccgatgtgtggctagggaatgcagaagaattgattcgtcgtggcgaagccaatcttgctgaagtaattggttgtcgggatgatatcatggtttatttaattcatgctggtttggacagtgggatggcctttaagattatggaaacggtacgtaaaggacaatggaataagattcctgatgaactacgggatacgtatttaaatgcgatgaaagaaaacaacgtccctgactggtatattgattcttgttctaaaattaaatatatgttcccgaaagcccatgcggcagcatacgtattaatggcgttgcgggtcgcttactttaaagtttatttcccaatcttatattactgtgcgtttttctccgttcgggcggatgacttcgacttagtggcaatgtcacaaggaaaagaagctgtgaaagcacgaatgaaagaaattacggacaaagggatggacgcctccactaaagagaaaaacttattaacggttttagaattatgtaatgaaatgttggaacggggctataaatttggcatgattgatttgtacaaatcagatgctgaaaattttgtgattgaaggggataccttgattgcacctttccgagcagtgccaagtttaggcctcaacgtagcgaaagccattgttgctgcgcgagaagagcaaccgttcttatcgaaagaagatttggcaacacgaggcaaagtttctaaaacgttaattgaatacatgaatgaaaatggtgtcttaaaagacttgccagatgaaaaccaattatcattatttgatatgtta

SEQ ID NO: 56 - DNA, 2040 bp, Enterococcus faecalis
atggaacgaagcaatcgtaataaaaaatcttcaaaaaaaccacttattcttggtgtttctgccttggttctaatcgctgctgccggtggcgggtattatgcttatagtcaatggcaagccaaacaagaattagccgaagcgaagaaaacagctactacatttttaaacgtattgtcaaaacaggaatttgataagttaccgtccgttgttcaagaagctagcttaaagaaaaatggctatgatactaaatctgttgttgaaaaataccaagcaatttattcagggattcaagcagaaggagtcaaagctagtgatgttcaagtcaaaaaggcgaaagacaatcaatacacatttacctataaattatcgatgagcacgcctttaggcgaaatgaaagatttgtcttatcaatcaagtatcgccaaaaaaggcgatacctaccaaatcgcttggaagccatctttaatttttccagatatgtcaggaaatgataaaatttcgattcaagtagataatgccaaacgtggagaaattgtcgatcgtaatggtagtgggctagcaattaacaaagtgtttgacgaagtgggcgtagtgcctggcaaactcggttctggcgcagaaaaaacagccaatatcaaagcttttagtgataaattcggcgtttctgttgatgaaatcaatcaaaagttaagccaaggatgggtccaagcagactcctttgtaccaatcacagtcgcttctgaaccagtgacagaattaccaacaggggctgcgacaaaagatacagagtcacgttattatccgctgggggaagcagctgcgcaattaatcgggtatacgggcaccattactgcagaagatattgaaaaaaatccagagttaagtagtacgggcgtaattggtaaaactggcttagaacgagcgtttgataaagaattaagagggcaagatggtggctcactagttattttagatgacaaagagaatgtcaaaaaagctttacaaaccaaagagaaaaaagatggtcaaacgattaaattaacgattgacagtggcgtacaacaacaagcttttgctatatttgacaaacgccctggtagtgcggtcattaccgatcctcaaaaaggcgatttattagcaacggttagttcaccttcgtatgatcctaataaaatggccaatggcatttctcaaaaagaatatgatgcttacaataacaacaaagatttaccattcacagcacgttttgcgacaggctatgcaccaggctctacctttaaaacaattaccggtgccattggtttagatgcagggacattgaagccagatgaagagctagaaattaatggtttgaaatggcaaaaagataaatcttggggcggctattttgcgacacgtgtaaaagaagcaagtccagtcaatctgcgtaccgctttagttaattcagataatatttattttgcccaacaaacattacggatgggagaagacaaatttagagcgggtcttaataaattcattttcggtgaggaactagatttaccaattgccatgacgcctgctcaaatttcaaatgaagataaatttaattctgaaattcttttagcagatacgggctacggtcaaggtcaattgttaatttcgccaatccagcaagctaccatgtatagtgttttccaaaataatggaacattagtctatccaaaactagttttagacaaagaaacgaagaaaaaagacaatgtaatcagcgccaacgcagcgaatacaattgccacagatcttttaggtagtgtggaagatccttcaggttatgtttataatatgtacaatccgaacttctcattggctgctaaaacaggaacagctgaaataaaagataaacaagatacagatggcaaagaaaacagtttccttctaacgttagatcgtagtaacaataaattcttaacaatgattatggttgaaaattcaggagaaaatggttctgcaacagatatcagtaaaccattaattgattacttagaagcaaccattaaa

SEQ ID NO: 57 - DNA, 1515 bp, Enterococcus faecalis
atgaaaaaagtgttaatgggagttctttccctagggttattattaggtgcagcaacaggttgtacaagcgatcaagaaaaagccgctggtaaaacaaaagcgtcttctgaaaaaacagaagcaacatctggtgcctctgctaatggttatacagatccaagtgaactaaaagacagttatgatgttgttattgttggttcaggtggtgcggggatgaccgctgcattacaagccaaagaagctggcatgaatccagttattttagaaaaaatgcctgttgcaggtgggaatacaattaaatcgtcttcaggaatgaatgcttcacaaacaaaattccaagaaaaagaaggcattaaagatagcaacgataaattctttgaagaaacactaaaaggcggtaaaggaaccaacgatcaagaattactacgttattttgttgatcattcagctgaagcaattgattggttagatacaaaaggaattacattgagcaatttaacgattacaggtggaatgagcgaaaaacgcacacaccgacctgctgacggatcagcaattgggggctatctagttgacggtttagtacgtaacgttcgcgaagaaaaaattccattgtttgttgatgctgacgtcacagacttagttgaagaaaacggtcaaatcgatggcgtaaaagtgaaaatgaaagatgataaagaaaaaacagttaaagcaaaagcagtcgttgtcacaacaggtggtttcggtgccaacgaaaaattaattacacaatacaaaccagaattgaaaaactatgttacaacgaaccaagaaggcacaacaggtgacggtatccaaatgattcaaaaagttggcggtgcgttagtggatatgaaagaaattcaaattcacccaactgttcaacaaagcgatgctttcttaattggtgaagcagttcgtggagaaggcgcaatcttggcttctcaaaaaggagaacgttttgttaatgagttagatacacgcgacaaagtttctgcagcaatcaatgccttaccagaaaaatcagcttatttagtctttgaccaaggcgttcgcgaccgtgcaaaagccattgatttctatgatcaaaaaggtttcgtggaaaaaggtgaaacgattgaagaattagctgaaaaaattggcatgcctgccgatacattgaaagcaacgattgatacttggaaccaagatgttaatgccaaagatgacaaacaatttggccggacaactggaatggaagctgacttaagcacagccccttactacgcaattaaaattgcaccagggattcaccacacaatgggtggcgtgaaaatcaacacgaaaacagaagttttacgtgaagatggcacaccaattaaaggtctatatgctgctggtgaattaacaggtggcttacatggtcaaaaccgtatcggaggcaatgcaatcgccgatattatcatttatggtcgtcaagcaggtacgcaatcagcagaatttgcctctgctcaaaaa

SEQ ID NO: 58 - DNA, 792 bp, Enterococcus faecalis
gtgattgttcgcggagggggcgatctagcgacaggtgttatccaaaaattatggcacgttggctttaaaatactagtattagaaacagaatgtcctctggccattcggcggactgtttcagtttgtgatgctatttttcagaaagaacaaagagtggaagatttggttgctgttcgaattacttcattaaaggattgcgcgaaatgttggcagcaaaataagctgcctgtttttgtcgatcaaacagcaagtgctattcaacaattgaaaccactgattgttatcgatgcgattttggctaagaaaaatttaggtacgcatcgaggaatggcaccgattacgattgctttaggaccaggcttttcagcaccgcaagatgtcgatgttgtgattgagacaatgcgtggccataggttgggacgtttatactttgaaggaacagctttacctaatacaggtattccaggtgaaattggcggaaaaagtgcggaacgagttgtccatgcccctgcttcaggacaagttacccaccttaaaaacataggggatctcgtgttgaaaggggaagcattatttttaatcgatcaggttccagtttattcgcctctgacagggactttgagaggattgatttcagaaaaggtaacatgttatcaagggttgaagtgtgcagatgtagatcctcgaccagttgagaaagtcgattgcttgacgatctccgacaaagctcgtgcattagggggagcggttttagaagcaatttttatgattggaagaaggaaaaacgtttta

SEQ ID NO: 59 - DNA, 2571 bp, Enterococcus faecalis
atgtattcaattattgtaaatggtcaaagtgaaacctgtgaaacaaacaaaaaattaatggactttttgcgggaggatctgggcctaactggaacaaaagatggctgtaaccaaggctcttgcggtgcatgtacggtgttagtaaatggaaaggcttccaaagcatgtttgtttactctagaaaaattagctggtaaagaagtcacgacaatcgaaggtttaagccaacggcaaaaagatgtctatgcctatgcgtttgcaaaaacgggtgcagttcagtgcgggtattgcatccctgggatggttatttcggcacaaggattattgaacaagaaacccgaacccacaaaagaagacattcagaaagctatacgaggaaacatttgtcgttgtacaggatatgtgaaaataatagaagccattcagttagctgctaaaatgttttgtgaagaagcgagcattccagaagaacattcaaatggtaaattaggggaagacttccaacgggtcgatgcagtggagaaaaccttaggaacagggatttatgtagatgacattgacatagaaggaatgcttcatgcatctgctttgcggagtgcctatcctcgcgcaaaagttctatcaatcgatagtacccaagcattggcgcatcctgactgtgtggctgtgttcacagctaaagacgttccaggaaataataaaattggtcatttagaatttatttccgattgggatgtaatgattccagaaggagaaataacacggtatgttggggatgcagtagcactcgttgtttcaaaaagaaaagaaaccttaccagagataaaaaatttagtggaagttgattacgaagaaatgataccgcttacttcttgtgaagctgctttagcagaaggtgcaccagctattcatgaaaagggcaatatcttgtctcatgaacacttggtacgtggcaatgcagaggaagtgttagaaaattctgcgtttgtagtgacagaacattattccgtaccaattaatgaacatgcctttatggagcccgaatgtgcgattgcacaacctgaaggtgagggcattttactctttagtgcgggtcaaagtatctatgatgaacaacgggaagtggctcggatgctagggctagacaaggaaaaaattcatgttcaatcaaaacttgttggtggtggttttggtggaaaagaagacatgagtgttcagcatcatgcatccttagccgcttggttattgaagaaaccagtaaaagtactgctaagccgtgaagaaagtttgatggttcatcccaaacgccatggcatggaaatggactttacgaccggctgtgatgaagaaggcaatttaactgcaatgaaagcagtgatttatgcggatactggggcctatgcttctttaggaggaccggtattgcaacgggcttgtacacatgcggcaggtccctacaagtatcaaacgattgatgtggaagggtttgctgtatatactaataatccgccagcaggtgcatttcgcggatttggtgtttgccaaacggcttttgcaattgaaagtaatttaaacttgttagcagaaaaagtcggactatcaccatgggaaatacgctttaaaaatgccgtcgccccaggagatactttaccgaatggacaattggtctcgaaaaatgcagcgttaaaagaagccttgttagcggttaaagacgtctatgaacaagcggaagttgctggaatttctagtttctttaaaaatagtggcgtgggtgtggggctacctgatacagggcgttgtattatttctgttgaagaaggaaaaatacatgtccgcacaagtgctgcttgtatcggtcaagggatggcaaccgttacgacgcaaattgcctgtgaaacattaaatttaccaccagaaatgattgttgcggaagcccctgatacaagaagaacaccgaattcaggaacgacaacggcttcgaggcagtcactcttcacaggagaagcaactagaagagcggcaatgcaattacggtatgagcttgatatgggacgtgctttaagcgatttggaaggcgaagaattttatggggaatattcagcgaaaacggatccattaattaatgataaaaaaagtccagttagtcatgctggttatggttatgctgctgaagtagctattctagatgacaaaggaaaagtagctaaatttgtggctgcgtatgatatggggcaagtggtgaatccacgagctgctgaaggtcaaattgaaggtgggattgcaatgggcatggggtatgctttaactgaaaaatttgccttagaagaaggctatgttaaagcaaaatatgcaacgctaggattagtgaacgccactcaagtaccaccaatcgaaacaattttggttcatgctgacaatcttcacgaaggtttagcttatggaattaaaggcgtaggtgagttagcaacgatccctaccgcaccagctttagcaggcgcatattttgccttggatggtcagctccgaccaagtctgcctttagaaaataccccttatcaaaagaaaaaaaga

SEQ ID NO: 60 - DNA, 3003 bp, Enterococcus faecalis
atgagtgatattatgcatcccatctcaattgaggctttattaaattggatttttagtgagtatcaacaagatggcacaatttttggcattcgtaaattttatcatgcggatcctacaaaaacgatttcgttatttggagaaaaaatggaaaccccttgtggtccagcagcaggtcctcatacacaattagcacaaaatattattgcggcctatttaacaggttctcgtttttttgaagttaagacagtccagatactggatggagaagatttacctgtgagtaaaccatgtatcgcagcagcagatgaatgttacaacgttgagtggtccacagaattgcgcgttccccaagcttatgatgaatacgtcaaagcatggttcgttttgaagttacttagtaaagagttcgagctaggtgacccgaatggtttcatttttaatatgagtgttggctatgatttggcagggattcaatcaccaaaaattgatcgttatattaacgaaatgcagaacgcagaaggaacgccgatttgggcggaatgccaagcagctgccaaaaaatatctatcttattttaaaaaagtagatgacttatatatcgaagcaattagtcctaaagtctgtcattctattacgctgtcgactttacacggttgtccatcagacgaaattgaacgaattgcggcctatttattaagtgaaaaagggctccattcctttattaaatgtaatccaaccatgttaggttatgaatatgcgcgtcaaacgatggatgagctagggtttgattatatggtttttgacgatcaccattttaaagaagatttacaatttgaagaagcagtaccgatgttacaacgtctgcaattattagctaatagtaaaaatctaagcttcggagttaaaattacgaacactttcccggtaacgattgcagcaaatgaattacctggtgatgaaatgtacatgtcaggacgttcgctatttcctcttagtatttcattggcacaaaaattatcagaagcatttgatgggaaactacaaatttcttattctggcggtgcagatattttcaatagtaaagaaatattcgatgctgggatttggccaatcactatggcaacgactctgttgaaacctggtggctatcaacgaatgaatcaagttgctaatgtattaagcgcagcagaatatcctcagatggtccatgtcaacttggataaattagctcaagttgttgagaaagctaaaacacaagcgcgttaccaaaaatcaattaaattaccagaaagtaccaaactaagaaaaacagttccgttaacagattgttatattgctccttgtcgaagtgacggtggttgtccaatcaatcaggatattcctgcttaccttcgttatgtcagtgaaggtaattatttaaaggccttgcaagtaattgtcgataagaatccgttgccttttattactggaaccatttgtgcacatccttgtatgactaaatgtacacgtcaattttatgaagaatctattcatattcgggaagtgaagttagaagcagctgaacatgcttatgatgaattattgacgacactagaaaagccacagccaaaagaaaatgcacctaaaacagctgttgtgggtggaggccctgcagggatctctgctgggtatttattagcacgtgaaggcatgcctgttactgtgtttgaaaaatccgagacaattgggggcgtttgtagccagattgtaccagaatttcgaatttctatggaatctgttcaaaaagacgttcagttagcggaatttatgggagccgaattccgtacaggacaagaggcgccatcattggcggaattgaaaaaccaaggctatacgaatgttatttatgccattggtgcatggaaacatggggtccttcgtttagaatctggtcgagcattgaactcgttagaatttttaaaagcaaatcgagaaaatccaacgattaatccttacggagaacaaattgtcgtcgttggtggcggaaatacagccatggactgtgctcgtgcagccacaacattacctggtgttaaaaaagtctcagtggtttatcgtcggaataaacgcaatatgccagcagatgaagaagaactttatttagctttagaagatggtgttgactttttagaattactttcgccaattaaacatgaaaatcaacaattaacttgtgaaaaaatggtcctaggtgaacgagatgcctctggacgccgtcgaccaattggtacaggagaaatgattgatattcctgctgatacagtgattgccgctgttggtgaaaaagtagatacagaattttaccaagcattaggcattcacacagacaactatgggaaagtcgtttcaaatcaagaaacattggaaacaaatataccaggtgtctatgtcattggtgacgctaatttaggaccagccacaattgttgaagcaatcgctgatgcaaccaaagcggccaataatatttgtcttgtccacaatcatcactatgaaaaagataatttaaatagtgatgtcgcatttgttagaaacaaacggggtatccttgtgacagacgagatgtcttgtagtcaagctagtcgttgcttagaatgctccacaatttgtgaatcttgtatggatgtctgtccaaaccgagcaaatattgttgtgtatgtcgaaggaaaaccacaaattgtccatgttgatcggatgtgtaacgaatgtggcaactgtgaaacattttgcccttatgcaagtgccccttacaaagacaaatttaccttatttaacagtgaagctgatttttatgacagtactaattcaggtttctatgttcaaaatcctgtggataaaatttgtttactgcgtctatggggaacggtgtcaacaattcaattaacagatcaaggattagatgtaccagaagatttaattgcattaatggtaactatgattgaagaatatgcttattgtatgcaagca

SEQ ID NO: 61 - DNA, 2367 bp, Enterococcus faecalis
atgacaaaacaaacaattaaagagcaaattttacatttcatggaaagccaaaaaaagaaaagcttttcaatggaagaaattgcacaaggcttgaatttagaaaaaagttcagattttaaaattttagtgcaaaccattgcacaaatggaacgagaaaagtcagttagtttcaacaaaaaaggcaaagtcctgttaccaatgaaagacttattaatagaaggaacgtttcgtgcaaatgaacgaggctttggttttgtaaccatcgatcctgaagaaccagatgtttatattccgaaagaggcaacgaactttgcaatggatggagatacggttttaatcgacgtgatccaacatgcggatcctttttcagatcgcggcgcagaaggtaaagtcaaagaaattaaagagcgagcagtgagccaagttgtcggagaatttgtggcatatagtgaagaagaaatggcagaaatgggactgtatggctacatgattcccaaagataagaaattgaatcagtatactgtatcaattgcacctgaagggattaagccagtagatggtagcattgtcattgctgaaattacctattatccagatcaagaatatccaacgagtatggaaggactagtcaaacaagtgattggtcataaaaatgatccaggaatggatattttatcaatcgtggtggctcatggaattcccacagcatttcctgatgaagttttggctgaagcggaccaagtaccagaaactattgcagaaagcgatttagtcggtcgtcgggatttacgtgatcagttgattgtgacgattgatggagaagatgcgaaagatttagatgatgcagtaacggtacaaaagttagcaaatggcaatttctttttaggggtgcatattgcagatgtttcttattatgtaactgaaggaagccaattggatatggaagcgtatgaacgtggtacaagtgtctatttgacagaccgagttgtgccaatgattccgcagcgattatcaaatgggatttgttcgctaaacccacatgttccacgtttaaccatgagttgtgagatggaaattacaccagaaggagaagttatttcgcatgaaattttccaaagtgtaatccaaacaacggagcgaatgacctatacagcagtcaatgaaattttagaagagcaaaaacctgaaacgttagaacgctacaaagaactagttcccatgtttaaagagatgggtgagctgcaccatatattagaagagatgcgtatgcgccgtggtgcgatttcttttgaagatcgtgaagccaaagtcctagttgatgaaaatggtcatcccaaagatattcttttacgcacgcgtggtgtgggtgaacgattaattgaatcctttatgttggcagcgaatgaaactgtggcgcgtcattatcatgacttaaaactgccatttatttatcggattcatgaacaaccaaaagaagaaaaaatgcaacgtttctttgactttgctgcagtacttggcattcttgttaaaggaacaaaagaaaacatttcaccgaaagatttacaaaaagttttagagcaagttgaaaataagccggaagaagtggttatcaatacgatgttgctaagaagtatgcaacaagcgaaatactcagaagacaactacggacactatgggttggctgctgaatattatacgcatttcacttcaccaatacgtcgttatccagatttaattgtgcatcgtttgattcgcagctatagccaagatcaatctgaaaaaaatcaagaaaaatggaacgaagcattaccagaaattgccaatcatagttcaagtatggaacgtcgcgcagttgatgcagagcgtgaagtggacgccatgaagaaagccgaatttatggtagataaagtgggagaaacgtatgacgggattatcagctcagtcacaaaatttggtatctttgtggaactgcctaatacaatagaaggcttgattcacgtgaacaacttaaaacaagattatttccactttattgaaaatcatatggcgttagttggtgaacggacgggaatgactttgaaaattggtcagaaagttcaaatccgtgttgaaaaagctgatccagaaacaagagaagttgattttgaattgatttcagctgaggaagtcgcgccagtcgaaggaccaaaaggacgtaaaaaaggcaaagccaattcttcaactcgttcaaataatcaacgaagaaataaaaaagatgaatcatttgatggtaagaaaaagaaaaataagaaaaaaggcaaaggcaaaaaacaacctttttataaagaagcaatgaaacaaaaaaataaaaaagggaaaaagaagaag

SEQ ID NO: 62 - DNA, 1023 bp, Enterococcus faecalis
atgaaaaatagatattttattctgatgatcctaagtttttatttctttgcttttgggattgaaacctcagcagcagaattacgatttagtgttgaaacagaaattccagaaaaccaaatagataaaacaaaaacatattttgatttaatgatgaaaccagaccaagaacaaattttgaaagttcgagcggccaatagtacagatgaaaatttagtgattgatgttagtgtgaagtcggccacaacaaacagcaacggagtgattgaatatggtgagtcgttgacagctttagataaatctgcaccagcagatttatcagaaatcattcaactgaaagacggcggtgagagtgttgaattgcctgctaaaagtgaaaaagcagttgaattgcgagtgaagatgcctaaagaagagttttcagggcaactagcgggcgggatcacgtttagtgaaaaagtcgatgaaacgaaagacaagcaaaaagaaaatacaaacggcttagcaattgaaaatcgctatgcctatacagtagctgttttacttcgagaaaatgaaacagttgtacaaccagaattgtctttagagaaagttgaaccgacacaaagaaatgcgcgcagtgttatttctgcaacactgttaaaccatgaagcagcctatcttcaatcaatgaaagtaacggcaaatgttaaaaataagaaaacaaataacgttattttagagaaagaacaagaagatatgcaaatggcgcccaattcaatttttaatttccctattccttatgaagaaaatgaaatggaagctgggacgtatgtattggcaatgactgtggaaggctcaggaaaaaaatggcaatttacgaaagaatttacgatctcaaaagaggaagcaaaaacatttaatgagaaagatgtaaccgtcaaaaaaacggaatctaaacttatttatctcttaatcggtttattgatccttttactgataatctgcctgttcatcattttacgtctgaaaaaacaaaaaaataaa

SEQ ID NO: 63 - DNA, 1122 bp, Enterococcus faecalis
atgagtaggaagcgaaaaatcagcttaattagtttagtcatcattttggtttttgtcacagtcggctcagcatactttgctgtagcgggtagctatttaaagaaaacaattgataaaggctatgttcccataaaaaatgattataatgaagcgcaaaataaagatagtcaatcgtttttgattatggggctagacaatacaattgaacggaaattaggcacaactaggactgatgctatgatggtgattaccgtgaataacaagacgaagaaaataacctatttaagtttgccacgggatagttttgttcaaattgatgcgaaaaattaccaagggatgcagcgaattgaagccgcctatacctacgatggaccaacagcttctgttaacacagttgagaaattattgaatattccaatcaatcattacgttgtgtttaactttttatcttttattaagttaattgatgcggttggcggcatagatgtcaatgtcaagcaggcgtttgatggtgtcaccaaagacgggccaggatccattcattttgatgcagggaaacagcatttagatggtacgaaagctttatcttatgcccgtgaaagacatagcgataacgatattatgcgtggattccgacaacaagaaattattcaagcagttgaagacaagttgaaatctggtcaatcaatcatgaaaataatggacattattgattcgttaaatggaaacattcaaactgatgtggattccaatgaattgactcatttagtcaaagaaggtttgacttggaccaattatgataaacaacagctttcttttgactggcgcacttttagtaatgaagggcgcagtatggttgaactatacccagatagtattgaaaatgtccgtcatcaattacgtgtgtctttaaatttagaaaagccagatgaacgagatcaagacggctatgtcttccatacgaacggtgaatttttatatcaaagtgattataccgttcaagatgaagcagctgaggaaaacgaaatgacttccatcaacggcaatacgtatattggtgttcctggtaatacacagaccggcccgttgccatcagttaaaacggaaaatggctttataaaa

SEQ ID NO: 64 - DNA, 1101 bp, Enterococcus faecalis
atgaaaaaaagtcaagctgttcaattaattcaggaactttcaaatgctaatggtgtttcaggctttgaaacagaagtcgttagaatccttcaacacgcaactgcggattttactattcaacggctagattccattaaaaatttatatcttgagaagaaaaataatctaagtgaaggtccagtagtgctttttgatgctcatagtgacgaagtgggttttatgattcaagcaattaaagaaaacggcttgttgcgtttttttccgttaggtggctgggtccctaatacgatttctgcacaaaaagttcggattcgtaaccgggaaggtacctatctgccaggcgtagttactagtcggccccctcattttatgacaccagaggaacgtcagcgaccgttaaccattgctgatttgacgatcgacattggtgctacctcaaaagaagaagtaattgaaacttacaaaatcgatcttggtgcaccggtcattccagatgtgacgtgctgttacaacgaacagacagatctttttttaggaaaagcttttgattgtcgcattggctgtgcttgcttagtggatgtcatggaggagttgaaagaagagacgcttccattcaagttagttgcgacagtaactgcacaagaagaagttggcgaaagaggagcacttattgccgcaaaacaagtcaatcctgatttagctattgttttcgaaggctgcccggctgatgatacggcagaaacgccagagatgattcaatcagcaatgggaaaaggaccgatgttacgttattttgatgtttctatgattacgaatccggaatttcaagagtatgcactagagattgctaaaatacacaaaattcctgttcaagtttctgttcgaagtggtggtggaaccaatggcatggcgattacacaagttcaaggagccccgacgattgttgtaggaattcctgtccgttacgctcacacaccccattgctatgtagattttcaagattaccaagcggcgaaagaattagtcattcaattaatcaaaaatttagatgctgacaaaattcaagcactggttcagccattgtcaaaggagtggaacaaa

SEQ ID NO: 65 - DNA, 1212 bp, Enterococcus faecalis
atgaccacgagtcaaatgattgccgattttaccacacttgctattcaagcaggtggttggatggaattggatcgcttatatcttcagaaccgtttattatcaatgattggtgaacaagaattaggcgaagtagacatacggcctgtggcaacacccgccgctgatttggcggaacaattgtgtcaagttgcgagtgccaaccaacttgtaaaaacagagcaacaaaaagaacagttcatggtgcaattgatggatttgttaacaccgccaccttctgtggttaatgctttttttgcacaacattatgccaaagagccacaagaggctaccgagtatttttaccaactttgtcaaaaaaacggtacggtcattgaacaggaagaacctgttgttttttcaacagtctatggagattttttagcaaataaggtccacagtgaggcgtcaaaagcaacgctctctgcacaaagctatccccgctgtgaatggtgcatggcaacagaaggctaccagggaagtcagcaatttcctgcgactacgaaccatcgagtgattcgaatgaacttagatggcgaaagctgggggttttcctttgtaaaacaggcacaatatcagcaacaaggtgtgattgcgtttgaaaaacatcagtcagcgaaacgttcaattaagacttttcagcaattgttgaaaattgttgaggtctttcctcattattttgctgggattgatgctgactttgaacaaaatgagcatgtctattatcaaacgggtttgcaacaatttccattagccgaagcgagcatttcagaatatgttgagttagctaactatcctttaatcaacgcaggaatggtgaattggccagttgagacatttcgcctagagggaccgaatgcgtcagaagttgcccaagccgcaaatgatatttttgagcaatggcaaatgctaaaactgccaacggatgagatacaaatcgttgcccgacgaaaagaacttttatatgtcatggacttaatttttagtcgacctcaagcaaagccttcgttaacgttagcagaagtccaaggtttaacgacttggaacaaccagaaaacgcaggcacttgaaactgtcgcttcagcgtatcaacagcgattaaaagaagccagtgcgtttgcagaaacaagtgaaggaaaagcggcttttttagcaatggttgcgccagtgactcat

SEQ ID NO: 66 - DNA, 396 bp, Enterococcus faecalis
atgagtattttatgggtaatcaatggcattttgctagttattgtactagcgatggtattcaatgaattatatttgaaaattatggtgaaacgttcagcaaaaatgctgacggaagaagaatttaaagaaacaatgcgtaaagcacaagtgattgacgttcgtgagaaagatacatttgatgctgggcatattttaggggcgcgcagcatgccatacagcatgttaaaaacaacaattggttctcttcgtaaggatcaacctgtttatctttatgatcagaagaaagctttaagtatccgagcagctaatctattacgcaaaaatggctatactgatatttatattttaaaaggcggctatgatggctggactgggaaagtgaaaaagagaaatagt

SEQ ID NO: 67 - DNA, 711 bp, Enterococcus faecalis
gtgatttttatgaatcctgatgaaccaaatttcatttggaaagatttgaatgcagttcgtgatatggggtgcattatcgaaaatgagctgtcagaggttttaccaaataaacgatatgaaacgtattcgattatcggaagaagtggtgaatttaatgaaacgttcaatgattatgaaccctttgattatgaaattgaagatgtaactattccatatgaaaatttagcggcagtcaaaagatggttaactggtaaaagtaaacttattactcacaatgatgaagataaatatttagatgctatttgtacaatgagtaaaccaacttcattcaaaaatgaatggggtgttttttatacctttaacgttgaatttagatgtcaaccgttcaaaagaaaagtaaacgaacaaccaaaagtgattaaaacaaaatcaattgaaattactgatcacggtgatgaaattgcttttccttatatcgaaattaattcaaaaggtggcgatattacgttaaacattggtagtaactcactaacgattttgcgtacacaatcaggaatcgtcactattgataccgaaaagggaaaagcaatacaagaaggaaatccactatttacacgcggcagttggataaaaacgaatcccggtcaaaataaattaaatatatcaggaaattttatagaagctaagttttggaataggagcgcgtattta

SEQ ID NO: 68 - DNA, 1935 bp, Enterococcus faecalis
atgtctattcacattacttttccagatggcgctgttaaaccgtttgattctggaattacaacatttgatgttgctaaaagtattagcaacagtttagccaaaaaagctttagctggtaaattcaatggtgttttaatcgatttagatcgtcctatcgtagaagatggttcgcttgaaatcgtgacacctgatcatgaagatgctttaggaattttacgtcattcatcagctcatttaatggctaatgccttacgccgtcttttccctaacattaaatttggcgtaggtcctgcgattgattctgggttctattatgatacagataatggagaatcccctgtgacagcggaagatttacctgcaattgaagccgaaatgatgaaaattgtgaaggaaaataacccaatcgttcgtaaagaaatctcacgtgcagaagcgttagaattatttgctgatgatccttacaaagttgaattaattacagatttgccagaagatgaaatcatcactgtctatgatcaaggcgattttgttgatttatgtcgtggtgttcacgtcccttcaacaggacggattcaagtctttaaattactttcagtagctggtgcttattggcgcggaaactctgacaatcatatgatgcaacggatttatggcactgccttttttgataaaaaagatttaaaagagtttatcaaaatgcgcgaggaagccaaagaacgtgaccaccgtaaattaggaaaagaattagatttatttatggtttcacaagaagttggttcagggttacctttctggttaccaaaaggcgcaaccattcgtcgtacaattgaacgttatattgtggacaaagaaattagcttaggttaccaacatgtgtatacaccaattatggcagatgtggaattatacaaaacatctggtcactgggatcattaccatgaagatatgttcccaccaatggatatgggtgatggcgaaatgctggtattacgtccaatgaactgtccacaccatatgatggtttataaaaatgacattcatagttaccgcgaattgccaattcgaatcgctgaattagggatgatgcaccgctatgaaaaatctggcgcattatcagggttacaacgtgttcgtgaaatgactttaaacgatggccatacttttgttcgtcctgaccaaattaaagacgaatttaaacgtactttggagttaatggtggcagtctatgctgactttaacattacggattatcgtttccgcttaagctatcgtgatccaaataatacagacaaatattttgatgatgatgcgatgtgggaaaaagcgcaagcgatgttaaaagctgccatggatgaattagaattagattactttgaagcagaaggcgaagctgccttttacggtccgaagttagatgttcaagtaaaaacagctttaggaatggaagaaacattatcaaccatccaattagacttcttattaccagaacgttttgacttaacttatgttggcgaagatggtgaaaatacacatcgcccagttgttatccaccgtggtattgtctcaacaatggaacgatttgtggcttacttaacagaagtttacaaaggcgctttccctacttggttagcaccaattcaagcaactattatcccagtttctgtagaagcgcattctgagtatgcttatgaaatcaaagaacgtttacaagcacaaggcttacgtgttgaagtcgatgatcgtaacgaaaaaatgggctacaaaattcgggcctctcaaacacaaaaagtaccttatcaattagtggtcggggacaaagaaatggaagacgcaacggtgaacgtccgtcgttatggaagcaaagaaacgtctgtcgaagatttatcaattttcattgacagcatggctgctgaagttcacaattacagccgt

SEQ ID NO: 69 - DNA, 360 bp, Enterococcus faecalis
gtgtctaacaaaaaagtcgctggaacaatcatactgaacttaaacgatggtagtaaaaaatttttgatgcatccaataggtgaagcgattgagtttgcgatggcaaaagtttctgatgagatgacgggtttagctagtatgctacaatggttcaaagaagaggttcaattggacgttacttcaattagcttagtagaattaactaacgcgcatatcaataaagaaaatgttccgctgtttgtcttcgagatggatgaacaagcacttaaaaatgaaatggataaagactatacatgggtagcacctgcagaattaaaaacgatttggtcaaaatatcatattgaaggtgtcccaatgttt

SEQ ID NO: 70 - DNA, 654 bp, Enterococcus faecalis
atgaagaaatttgatggcgtaatttttgatatggatgggttgctttttgatacggagttgatttactatacatctactcaaaaagtagcagatgcaatggggttaccatatagtaaagaagtctatttagactatgttgggatttccgatgaagaagtacaagagaattaccgacgtatttatgcatcctatggtcatgacacagtggaagaatttatccgccgttcttatgatgataccttgcaagagtttcgatctggtaacgtccctttaaaaccaggggtggtggaattcctcgactttttagatgatcaaaaaattcctcgattagttgcttcaagtaacgtccgtccagcaattgaaatgttattaagccatgctggaattcaggatcgttttgtaggtattgtttcagcagaggatgttaaacgagcaaaaccggacccagaaatttttcaaaaagctcgtcaacttttaggaacagaagccccgaaaaccttgattttcgaagactcatttcatggggtaagtgcggctcatagtgcgggcattccagtgatcatggtacctgatttattgcaaccaactgaagttatccaagagaaaacattacatgtcttggagagtttacatcaagcgccacattatttaaaa

SEQ ID NO: 71 - DNA, 663 bp, Enterococcus faecalis
atgaacgaattagtatttttacattcacagtatatcgaggaagaaccttatacgaccgatgaggttattgcaaagtattcacaaattaaaagagaaagtgtttctaaactaataaaaaagtatcaaaaagacctagaagagtttggcaaggtcggatttgaaatccgagcaatggagagtgggcaaaaagctaaattctatcaattaaacgaggaacaagcgaccttgcttatcacttatctagataataccgaaccagttcgacgatttaagaaagcgctggtgcgacagttctatgacatgaaaaacggactctacgctagacgtatggaacgacaaaaggaaaaaagtgtgcgtaagtcaatgacggatgttatcaaggagttagggctttccccgcattactacaagcattatacagaccttgtttataagacagcattaggttttaatgctaagcaattaagagaagctcgagaggtaagtaaaaaatcaacgatattagattttttaacgtcagaagagatcgaagcagtgaacaaacgagagcaacaagtagctacattgcttactcttaaaatggattatgacacgattaagagcattttgaatggtcaaggtgttttatatcaaacaacgcttaaaatgccagtagcgacaaat

SEQ ID NO: 72 - DNA, 849 bp, Enterococcus faecalis
atgccaaaaccaggcgaaacaattcacgccattgaacattttacagcaggtggtggtaaaggagcaaaccaagcagttgcagcgaaacgttcaggcgcagaaacatattttattggtgctgtgggaaatgatggcgctggagctatgatgactgatttaatgagtcaagatgaaattaatttaactggggtcaccactttagagaaaacagctactggccaagcctttattatggtagataacgctggtgaaaatagcattatgatttacgcaggagccaataacgcctttacgccaaaacaagtccaggaacatcaagaaattattgaaaaaagtgattttgtgattgcccaatttgaaagtgcgattgatagtacgattgcagcgtttaaaattgctaaaaaagcaggcgtcaaaacgattttaaatcccgcacctgcgttagaacaagttcctgaagaattactaaacgtgacagatatgattgtaccaaatgaaacagaaaccgaaattttaacaggcattaaaatcacagatgaagcgagtatgcgtaaagccgcagaagcacttcatcaattagggattgaagcagtaattattacagtaggtagtaaaggcgccttttatgacgtcaatggacgaagtggtattgtgcctgcttttaaagtgaaagcggttgatacaacggctgctggcgatacttttattggcgcattaagtagtatattagaaaaagattttagcaatttggaagaagctattcgttatggaaacaaggcgtcttcgttgactgttcaacgttttggagcccaaccttcgattccttatcaacacgaattggcagacaaa

SEQ ID NO: 73 - DNA, 672 bp, Enterococcus faecalis
atgattaagctagcccatattcataaatattattattccgaagaagaaacactgcatgtgttagatgatattaacctccaagtagacgctggagaatttttagcgattatgggtccttctggttctgggaaatcgactttgattaatttgctaggctttattgataaaaagtttgaaggaacgtatttatttgaagaccgtgaaattggcgacttttctgataaggaactatcccgaattagaaatgaagcagtcggctttgtctttcagaattttagtttaattgaaacactaacagttgaagaaaacattgaattacctcttttatatagtgggttaaccccaaaagaagccaaagatcgtgtccacgaagttctgacaaaagtcggcttgccagataaaggcaagaagcatccaaaacaactttcgggcggacaacaacaacgtgttgccattgcgcgtgcgattgtcaatcggccaagttttattattgcagatgaaccaactggggctttagatagtaaaacatcggaagaaattttaacgctctttcagcaattaaacaatgaaggtgtcaccattattttagtgacacatgatgaagaaacaattgaatactgcaatcgtttgattaaagttcgtgatggaaagattttagaggaggtgctgaca

SEQ ID NO: 74 - DNA, 1164 bp, Enterococcus faecalis
atgaaaaagtcaggccagaagaagcgaaataaaaaagtgtggttcggtattggtgccgcagtggtcgtcgtcggatttatcggagcaaaaacagttttttcttcaaaagaagttgaacctgaatacacaacgtataccattacagaaatggcctcattaaaattagatggtcaagtgagttttctagatactcgggatattttctttgatccttctttaggaaaaattgccgaaataaatgttgaaaatggtaaagaagtcaagaaagatagtccattgttaacgtacaataactcagacatccaagccacagaaacagaacaagcgaatgctgttaatcggaacaatcttcaagttcaacaagcacaagagaacgttaacttagccactcaaaaatacaatgaagcgttaaacaaagttgctgcagccaagcaaaaattaaacaccgcaaaagaggctgaagagaaagaaacactaaatgcggaaattcagcaattgaatgaagccgttagtgctgcgaatagtgaagtcgcccaagctaaccaagcccttcaattagccaacagtgatgccgtcggagcagcaaacacgcttgaacaaacacgtggcaaagtcaacacagtcgttacagcaccaattgatggccaagtcactgttgatgctagtgccatgagtagtaccgacaaaccagtcattaaaattgcaacacaaaagaaaaatattcaaggaaaagtaaccgagtatgattacgataaattacagacaggggaagaagtaacagtgacgaccgttggttcaggtaaatcagcaccaggcaaaattgtttccattgcgcaaaccccaatagctaaaaatgaaggcaatccagtagtgagttatcaatttacagtagaaggtgattttccttgggcagaaggcttgtctactagtatcgctgtgccacaaaagcaaatgattataccgacagcagcaatccaaaaagaaggccaaaaagaatttgtctatgtttacaaagcgggcaaagcgaaaaaaacaccgattgaaacagaaacaaatttaggtcgtaaagttgtcaaaagtggcttgaattggaaagaccaagtgattgccaatcccaataaagaattaaaagataatcaagatgttcaggtagctgccaatgat

SEQ ID NO: 75 - DNA, 4116 bp, Enterococcus faecalis
atgattaaaaaaataatagtcgttgttgctttcatgcttacaggcttctcgctaactgcgatgagtgcatctgcagaagaaataactgatttatttttacaaaaagaagtgacatattctggtgtagaaggaggaaaaattggagagaattggaaataccctcaatttgttggcgaaaaagctgtcgatggcgatgaaacaacacgctggtccgctgataagcaagatgaacaatggttaattgttgatttgggtgaagtaaaaaacattggcgaactcgttttacagttgcatgcagaaagtcctgtgtatgaaatcttagtttcaacagatggtgaaagctatcaatctatctttaaagaagagaatgggaaaggtggccaacctactaaaaaatatattgatggcaataatgtacaagcacgttttgtaaaatatcagcagatgaaaatgtggcaacacacaaataagcaattttacagttcaagtattatttcgtttgaagcatatgaaaaaaaacgactgccagaagcgattaaacttttaacagagaacctgactattagtgaaaaaagaaagcaacagctagcctttgaagtgtcaccagctggagtagatatcacagaggatcagattgagtggtcgagtagtgatcctaccattgtgacggttgaccaaacgggtaatttaacagcagttaagagtggtgaagcgaaggtaacagtcaaaattaaaggaacagaaattagtgatacaattcctgtgactgttgtagcagaaaataaacaatatgcggaaatgcgagcaaaatggaaaatgcgattgttaggtacaacgcagtatgataacgatgcagatgtgcaacagtatcgtgcccagattgctacggagagtttagcattatggcaaacgcttaatcaagcagcagatcgtgagtatctgtgggaacgaaaaccatcggatacagtgtctgctgattacacgactcaatttaccaatattaaaaaattagcgttaggctactatgaaccatcaagtgagctttttgaaaaaccagaagtttatgatgcgattgttaaaggcattgaatttatgattgatacaaaaaaatacaatggaacgtattacacaggtaactggtgggattggcaaattggttccgcgcagccgctaacagatacattgattttattacatgatgacctattgaatacagatgcagaaaaattaaataaatttactgctccgctgatgctgtatgcaaaagatccaaacatacaatggccaatttatcgtgcaacaggagctaacttaacagatatttcaatcaccgttttaggtactggacttttgttagaagataatcaacgcctagtacaagtacaagaagctgttccgtccgttttaaaaagtgtttcctctggtgatggcttatatcctgatggttccttgattcaacatggttattttccgtacaacggcagttacgggaatgagttgctaaaagggtttggacgaattcagactattttacaaggttccgactgggagatgaatgaccctaacattagtaatttatttaatgttgtggataaaggttacttacaattgatggtaaatggaaaaatgccatcgatggtttctggtagaagtatttccagagcgccagaaacgaatccttttactacagagtttgaatcgggtaaagaaacaatagctaatttaaccttaattgcaaaatttgcaccagaaaatttaagaaatgacatttatacatctatccaaacgtggcttcaacaaagtgggtcatactatcatttctttaaaaaaccaagagattttgaagcgttaattgacttgaaaaatgtagtgaatagtgcgtcacctgcccaagcgacaccaatgcaatctttaaatgtatatggttcgatggatcgagtcctacagaaaaataacgaatatgcggtggggatcagtatgtattcacaacgtgtcggaaactatgaatttgggaatacggaaaataaaaaaggctggcatacagcagacggcatgctttatttatacaatcaagactttgctcagtttgatgaaggatactgggcaacgatcgatccatatcgattaccaggaacgacagttgacacaagagaattggcaaatggtgcttatacagggaaacgcagtccccagtcatgggtaggtggctcaaataatggacaggttgcctctataggaatgtttttagataaaagtaatgaaggaatgaacttagttgctaaaaaatcttggttcttattagatggtcaaatcattaatttgggaagtggcattactggtacgacagatgcttcgattgaaacaatcctcgataatcggatgattcatccacaggaagtgaagcttaaccaaggttcagacaaagataattcttggattagtttaagcgcagcgaatccattgaataacattggctatgtttttcctaattcaatgaatacgcttgatgttcaaatagaagaacgctctggtcgctacggagatattaacgaatactttgttaatgataaaacctatacaaatacatttgctaaaattagtaaaaattatggcaagactgttgaaaatggtacttacgaatatttaacagtggttgggaaaacgaatgaagaaatcgcagctctttctaaaaacaaaggctatactgttctagaaaatacagcaaacttacaagccattgaagcaggtaattatgtcatgatgaatacatggaataatgaccaagaaattgcaggactgtatgcgtatgatccaatgtcggttatttcagaaaaaattgataacggtgtttatcgcttaactcttgcgaatcctttacaaaataatgcatccgtttctattgaatttgataagggcattcttgaagtagtcgcagcggacccagaaatttctgttgaccaaaatattatcactttaaatagtgcggggttaaatggcagctcgcgttcaatcattgttaaaacaactcctgaagtaacgaaagaagcgttagaaaaattaattcaggaacaaaaagaacaccaagaaaaagactacaccgcaagcagctggaaagtctacagcgaagcattgaaacaagcacaaactgtggcagatcaaacaacagcaacgcaagcagaagtagaccaagcagaaacagagttacgttcggcagtgaagcaattggtaaaagtgccaactaaagaagtagataaaaccaacttgttgaaaatcatcaaagaaaacgagaaacaccaagaaaaagactacaccgcaagcagctggaaagtctacagcgaagcattgaaacaagcacaaactgtggcagatcaaacaacagcgacacaagcagaagtagaccaagcagaagcaaaactacgttcggcggtgaagcaattggtaaaagtgccaactaaagaagtagataaaaccaacttgttgaaaatcatcaaagaaaacgagaaacaccaagaaaaagactacaccgcaagcagctggaaagtctacagcgaagcattgaaacaagcacaaactgtggcagatcaaacaacagcaacgcaagcagaagtagaccaagcagaaacagagttacgttcggcagtgaagcaattggtaaaagtgccaactaaagaagtagataaaaccaacttgttgaaaatcatcaaagaaaacgagaaacaccaagaaaaagactacaccgcaagcagttggaaagtctacagtgaagcattgaagcaagcgcaaactgtggcagatcaaacaacagcaacgcaagcagaagtagaccaagcagaagcaaaactacgttcggcagtgaagcgattaacattgaaaaatagtggggaaaataaaaaggagcaaaaaaatggggggaataatggacacttaaatactagtacaggagttgatcaaactggtacgaaacaagttaagccatcaagccaaggtggtttcagaaaagctagccaatttttaccgagcacaggagaaaagaaatcgatcgcgcttgtgattattggtcttctagttatcgccagtgggtgtcttttagtttttcgtaaaagtaaatcgaagaag

SEQ ID NO: 76 - DNA, 1653 bp, Enterococcus faecalis
atgaagaaatctgttttatttacttcattacttgtattatcaagcttagctttagcggcctgcggcggtggcagtgacgataaaggagctagcaacggcggcagcgacaaccaagtatacacaatggttgaatcccaagaaatgcctagtgccgatccgtcccttgcgacagatgaagtgagttttaccactttaaataatgtctacgaaggaatctatcgtttagataaagacaacaaacccgcgcctgctggtgcagccgaaaaagcgactgtttcagaagacggtttagtttacaaagttaaattacgtgaagaatcaaaatggtctgatggcaaaccagttactgctgcagattacgtttacggttggcaacgaacagtggatcctgccactgcttcagaatatgcctacatgtttgaaccagtaaaaaatgctgaaaaaatttctaaaggggaactacctaaagaagaattgggcattaaagcaatcaatgatcatgaattagaaatcactctagaaacagcaacaccatattttgacgatttattggctttcccttctttcttgccgcaacgtcaagatatcgttgaacgttttggtaaagattatacaaagagtagcgataaagcagtctacaatggtccctttacgctaactgagtttgatggtcccggaacagatactaaatggtctctaactaaaaatgaagaatattgggacaaagagacggtcaagttagataaagtcgctatcaacgtggtgaaagaagccccaactgccttaaatctttatgaaactggtgaagtggatgatacgtatttatctggcgaactggctcaacaaatgcaaaactcgcctgacttggtccaattaaaagccgcttcttctttctatttagaaatgaatcaagcagatgaaaaatcaccattgactaatgcaaacttacgtcgtgctatgtcttatgccatcgatcgcgattcattagctaaaaatattttagctaatggctctcttccttcacaaggcttcgttcctgtggatgtcgcgaaatcaccaaaaacgggtgaagactttgttaaagaagccggcagcgacaaattagtcaaatacgacaagaaaaaagctgtggaatactggaacaaagcgaaacaagaacttggtgtttccaacttaacggttgatttaatggtagacgactctgaaggcgctaaaaaaatgggcgaatatcttcaaggatcactatctgatactttggaaggcttaaaagtaactgtgacgcctgtccctatggctgttcgcttagatcgtaccttaaaaggggatttccaaatcgctgttcgtggttggagtgccgactattcagacccaattaacttcttagatttattagaaagctcaacttctaataaccgtggacgttacagcaatcctgaatacgataaattcattgctgcgtccaaaaccacagatgttaacgatcctgaaaaacgctgggaagatctaatcaacgctgaaaaaacagtaattgctgatatgggtgttgtgccaatttaccaaaaagcagaatcacacttacgtgcaccaaacgtgaaagaaattatttatcatccaacaggtgctaaatacgacttcaagtgggcgtataaagaa

SEQ ID NO: 77 - DNA, 765 bp, Enterococcus faecalis
atgtcaaaaaaaccatcaggttaccaaaaaaaagttctcacggtgttgttggtatcgtttggctttggcgggttgttagcgcagttttcgccgatgaaatcaggtgggttttcaagttggtttgatgattcatatgtcaaagctagtgctgaatcaagtaaaacaaaagaaccagcaccagttaaaattgagaaaaaagtcaaacctttaagctatggacaacaggtcaatcaagaaattgaaaagaagcaatatgatggacatctggatttgccgttagaattgcagacagatgctaaatggaaagacaccgcatacggatttggcaatgtggataagccgaatacaatcgaaattaatggctgtgcgattgtatcgcttgcaatggttggttcatacatggatcaccaagaagttacccctctggatgtgttagcttgggcaaaaaatgacttctttatggaagggcaagggacggcgtggtctatttttagtgcatatgctgaaatgaaaggctataactgtcaagaaattggggatattgaaacagtggcagctttcttgaaggaaggtcatccagtcattatttctgtaaaaccgggctatttcactacaactggtcacattatggtgatgagtggtgtggatgaaaaaggcgatttctggattaatgatccaaacgattcagaagaaaagggccattcaaaacggacatttacagccgaagaagtgatgaatgaagcgttaaacttctgggcattttat

SEQ ID NO: 78 - DNA, 1446 bp, Enterococcus faecalis
ttgaagaaaagtgtattatcggctctaatggtatgttccattacattaacaagcgtagcgttgccatccgcagcatttgcagatgaatacgatacaaagattcaacaacaagatcaaaaaattaatgcgttaactagccaaatgtcagatgcagaagcaaaagttgccgcgattgaaaatgatatggttgaaacggccaaacaaatcgatacattaacagctaaaaagaacaagctatcatcagaagtatctaaattatatagtgaaatttctgatttgaatgtccgtattcaaaaacgtgaagtacaaatgacaaaacaagcacgcgatgtccaagtgaatggtcaaagtgattcaattattgatgctgtcttagatgcagattcagtagcagatgcaattggtcgcgttcaagcggtctcaacaatgatgagcgccaataatgaattactagaacaacaaaaagaagacaaagcgactgttgaaaagaaaacaaagaatgttgaaaaacaaattgctgaattagaagcagcaacaaaagaattaaatgataaaacagaatcattaaaaacattgaagattcaacaagaagtggctaaaaatgatttagaagcacaacgttctgaagaacaagggaaaaaagacggcttcattaaacagaaaaaagaagcggaaaaacgtttagcagaagaacaagcacgtcaacgtgcagctgctaaaaaagcagaagaacaagcggcagcgcaagcacaagccgcagcacaaaaagcggcagcagagcaagcgaaagcaacaaaagcagccaatgaggcagcagcatccgccgctgaagaaaaagccgcaacaccagtagtagaatcatcaacaactactgaaagtaccacaacgcaagaaacaacaacttcaagtactgaaacagaaagtgttgtaacaacacctgtggcagcagcacctgaaaaagaaaaagaagttcctgtaactaacccaacgactcctgaaaaaggcaatgaagcaaaaccagggaatggtggcgtgacttcaggaaaacaagccgcaattaatgcagctttagcagatgttggtaattcttatgcaacaggttggaatcaaccaggcgaatgtttagtatctgttcgtcgctggttagcggcaggcggtattaacttcggttatggtggtccaaacagtggctatgttgcttctggcgcaacacaagttagctggagtaacgtgcaaccaggcgatgttgttcaatatgaaagtgcctatagtccagatagctggattggtggcgtgcatactgtcttggttacaggtgtaagtggtggaagtgttcaaatcgttgaagcgaacaacccaggaggttctggttatgtttcttctaactctaactggtcaccagcaccaccagcaggattccgcgctgttgtatggcgttttccaggc

SEQ ID NO: 79 - DNA, 534 bp, Enterococcus faecalis
atgtcctcattattaaaacgattggttcagttggttttgttagtcgtcgctgtcttgctgattcgacactatgttttctcccctgctgcggtgaacggctcttcaatggaaccaacacttcataacaacgaccgtttatgggtgacctcgattaaaaaaccacagcgctttgatattatcgctttccctagtcctcgcaacggccaacgagtagccaaacgtttaattggtttacctggcgaaacagtcgagtatcgcgatgataccctttatattaatggtgtatcactcagtgaagattacttagcaagtgctaaacgaaatgtctctaaaaatgaaaattatacccaagattttacgctagagaccttagaagccacccaatccctgaccgttccagaaggcatgtattttgtcttgggggataatcgcccgcgctcagacgacagtcgttattttggctttgttaaacaagcgagtgtggaaggtgttttgacttttcgttattatccattagataaaattggctttcca

SEQ ID NO: 80 - DNA, 450 bp, Enterococcus faecalis
atggcgaatgatgacttacaacaacgtctggataaaggaatgtacggtacgcccctcgttaatcctgaagaacaacacaaatacatgggcacatttcgtgaacgctgccgtctctccatgaccgtcgctgaaatgaaagatgcacagaaccaaaaacatttattagaagaattagcgaagcatcctgaagttacagtacttttaaatggcgaaatctcttctgacctgcaaagtacctatattaaattattaaatcagcatggcgcaaactttaagattgttaacaattttgtggagaacaaccctgactctctcggcttactgttagctgaaaaacatgcagtcgatgaacctgtgattgacgttacagaaaaatatcctcaagcaacagaaacgccaaaagaagagccaacagctaaaaaaagcttttggcaaaaactatttcactca

SEQ ID NO: 81 - DNA, 3576 bp, Enterococcus faecalis
gtgtatttaaaacgaattgaaattacaggatttaaatcatttgcagataaaaccattattgaatttgaagatgatgtgacagcagtggttggtccgaatggaagtgggaaaagtaatatcacggaagccgttcgctgggtattaggtgaacaatctgcgaaaaaccttcgcggtggcaaaatgaacgacattatctttgccggttcggaaggtcgtaagccgctaaatattgcggaagttaccgtgacgttagacaacagcgaccattatttagcattggattatagtgagattagtgtcacccgtcgtttaaaacgaacgggcgaaagtgacttttttattaataaacaagcgtgccgtttaaaagacattcaagatttatttatggattcagggttaggcaaagaatctttttcaattatttcacaagggaaagttgaagcgatttttaatagtaaacctgaagaccgtcgagggatttttgaagaagcagcgggcgttttaaaatacaaacaacgaaagaaaaaggctgaacaaaagctttttgaaaccgaggacaacttaagccgtgtccaagatatcatttacgagttggaagaccaattagttcctctagccgcccaagcagatgcggctaaaaagtatttagctttgaaagaagaacttaccgaaattgatgtcaatttaactgtgaccgaaattcaagaagcaaaagctatttgggaaacgaaaacgcaagaattaacagccattgaagaaaagttagctggcgcaagtaagcaagtccatgacttagaaggcaaattggtacgtttacgcagcaagcgcaatcgtttagatgaacaaattgaaacggaacaacaacaattattacaagtgacagaagcgttgaaacaagcagaaggacaaaaaaatgttttaattgaacgttccaaacacacctcccaaacggcaagcgaatacgaagagacattggcagaaacggccgaaaaaattgttcgttatcgagaagaattgcagacgctggaaacagcaatcgcagaaaaaacggcacaacgtcagacgttaaaagaagcattggctttggcaacgaaagatgtggaaaaatatagtaagtcttctaaagaattaatggaagaattgcgcagtcagtatgtggaagtcatgcaagaacaagccaatacagccaatgacttaaaatatttagaacgacaatatcaacaagaaacagctaaaaatcaacaatcgttagcaaaacacgaagcgctagaagaacagatggttgaagctctcgcaatgaaagagacgctagaaaaagagcaaaaagttgcaaaacaaggcttacaagaacagttggaagaatacactgcgttgaaagcaacgcttgaagctaagcgtgaacgattagcacagcgtcaaaacgatatgtaccaagcgatgaatcaagtgcaacaagcgaaggcacgccaaaaaagtttgcaagaaattcaagaaaattacgctggcttctatcaaggcgtgaaagctgtattgcgtcacaaaaaccaattaactgggattgttggcgcagtggctgagttaattgaagtgcctaaagaatatacgttggcgattgaaacggccctaggtggtgcggcgcaacatattgttgtggaaaatgagaaagatggtcgagcaggcatcaccttcttaaaacaacaacacagtggccgagcaacctttttaccattgactaccattaagccacgctctgtatcggcgatggttcagaatcgtttggctggtgcaccgggcttcgtggggattgccagtgaactagttcgttatccagaacaagtacaaaccgttattcaaaatctcttaggcgtcacgattttagcggcagatttaacgagtgccaaccagttagcaaaattagtcaattaccaatatcgcgttgtctcattggaaggcgatgtgatgaatcctggcggttcgatgactgggggagccaataaacgtggcaaccaaggaagcctattttcacaagcgcaagaacttcaaacaattactgaacaaatgactcaattagaaacacaactgagaagtgtagaacaagaagtccaagcgctctcgcaagaagtgaaaacagccacggaacgtgcagaaatgttgcgctctgctggtgaacaaaatcgcttaaaacaacaagaaattgacaataaattagccaatcaaacagaaacgattactcgtttaacaaaagaaaaacgcttgtttgaatatgaatcacgggaattgcatcaattcttaaccgaatatcaaacgaaaaaagccacattgacagagcaacaagcaaacttaacggcaacgaaagaacgtttagatgctgaaatgaaacaagtggaacaagaagctagccaaatggaaacctttaaagcccaagcgcaagaacgcttgacgacagttcaagcagaacaagcagtagcggcggaacaatgtgcccattttgctcgtcaaaagcaagacaaacaagaacaattggacgaattgttgattcgagaaacggccatccgtcaacagctacaacaattaagtagccattctagcgatcaccagttaaccgaagaaggcttagcggcacaagtcgctcaattagcggagaaacaaacagcgttgcaaacctctttacaaacggcacgtagtcaacgacaagcgttgcaagaagaagtagacgagttagatacaaaattagcggaagaaaacaaacgccaacaacagtatttagcagataaaacacaaatcgaagtcctaaaaaatcgtgcagaaatgcaattagatagctcgttaagttacttacaggaagaatacagcttaacctttgaagctgcctatgaagcgtatttcccaatcgatgatttagcgcaagcgcagcaaacagtgaaacgcctaaaacaagaaattgagcggttaggacctgttaacttaagtgccatcgagcaatttgaacaagtcgatgagcgccatcaatttttagtcagtcaacgagatgatttattaaatgcgaaagaacaattatttgaaaccatggatgaaatggaccaagaagtgaaagaacggtttaaagaagtctttgaagcaattcgtggccagtttaaagtggtatttcctaatatgtttggtggcggacgggcagaactggtgctaaccaacccagaggatctcttgaatacagggattgagattgaggcgcaaccaccagggaaaaaattacaacatttaagcttgttgtctggaggcgaacgggcattaacggcgattgcgttactcttttcaattattcgtgttcgaccagttccgttctgtattttagatgaagtagaagcagctttagatgaagccaacgttgctcgttttggccattatttaagcgaatttgaagatggtacacagtttattgtggtgacgcatcgtaaagggacaatggaagccgcagatgttttatatggcgtgactatgcaagaatctggggtttcaaaaatcgtttcagttcgcttggaagaggtcaaagaaggtggcgcaattgaaaaaagcaat

SEQ ID NO: 82 - DNA, 2430 bp, Enterococcus faecalis
atgcaaaaagtagccaaagttattgtggatgtaccaacgatgcaaaccgatcaaccattcacttatttagttcctgaaaatttaaatgagcaattggctgtcggcatgcgtgtagaagtgccttttggtaacggtaatcggcatgttcaagggtttgttctagccattgaaccagtggctgcaacggttcttgacgaaaccaatgttcagttgaaagaactagtggcggtgttggatttaaaacctgttttaaatacagaaatgttggctttagctgattatatgaaggaaaaaacgtttgcttttaaaatcacttgtttgcaaaccatgttgcctagcgtaatgcgtgccgattaccaaaaatatatttatttaacggatgagctttctgaagaattacaagatcagttattttatggtttagaggaaatttcgtgggaccaagcgcaagaacgtgggcttttgcctcaactaatggcgttgcgtaaacagcaaaaagtcgatattcgctacgaagttacgacgagaaataaagtcaaaatggtccgcttcattcaagccgctaaggaatttgaacaactagaggaaattcgtttggggttacgcaagggagctaagaagaaagagcaacttctttactatttacaacgcttgggcactgaaaaagtcaccgctgtgaaggaaatgaaagaattaggtttcagtaccgcgcttttaaatgaagcggccaaaaacggctggttaacgttcattgaaaaagaagcgtatcgtgatccgtttgctaatcagacgtttgaaaaaacgactgcgttatctttgaatgcagaacaacaggtggctgtggaaacaatcttacaatcggtccaagaacagcaaagccaaacctacttattggaaggtattacaggaagcgggaaaacagaagtttatctacaggtcattgcagaagttcttaaccaaggcaaaacagccattatgcttgtccctgaaatttctttaactccgcaaatggtgcaacgctttaaaagtcgctttggcgaacatgttgctgtaatgcacagtggcttatcgcaaggtgaaaaatacgatgagtggcggaagattgaacgaggagaagcggaagtggtggttggcgcgcgttcagccatttttgcgccaatcgaaaacatcggcgtgatcattgttgatgaagaacacgaggcaagttataaacaagaagaaaccccgcgctaccacgcgagagatttagcgatttggcgttcggagtaccatcattgccctgttgttttaggcagtgccacgccatccttggaatcacgcgctcgcgcacaaaaaaatgtttatcagcggttacgattaacacagcgtgccaatcaagcggcaaccttgcctacgattgatgtagtggatatgcggcaagaagtagaaaatggcaatgtctcttctttttccatgtcgttgcaagaaaaactccaagaacgcttagagaaaaacgaacaaagtgttctcctacttaatcgccgtggctattcgtcatttgtgatgtgtcgcgattgtggctatgtgttgccgtgtccgaattgtgatatttccttaactttgcatatggatagtaaaacaatgaaatgtcattattgtggacatgaagaacggattccttatcgctgtcctaactgtggccaagataaaattcgctactacggaacaggcacacaaaaagtagaagaagaattacaaacgttgttaccagacagtcgtattctccgaatggatgttgatacgacccgtcgcaaaggtgcacatgaaaagattttgcgaacatttggtgaaggacaagcggatatcttattaggcacacaaatgattgccaaaggactggactttccaaatgtgacgttagtcggtgtcttaaatgctgataccgccttgaatttacccgattttcgttccagtgaacggaccttccaattattgacacaggtcagcggtcgagctggtcgcgctgaaaaaccgggggaagtcatcattcaatcttttaaccccgagcattatgcgatacaattggcaaaagcccaagattatgaagatttttatacaaaagaaatgtatattcgtcatcgtggggattatccgccgtactattttacggtccaaattacggctagccatcctgaagaaaatgaagcagcgaaacaaatgtttcaaatcgcgacgaaattaaaacaaggcttatcgccgcaagctattttgttgggaccaacacccaacgcaattatgcgtgtcaataatcgatacttttatcaagtgattatcaagtataaacaagaaccaatgcttcaaccattattgaaagaaattttaaccgatacacaacgagcaacggctcgtggcttaaagctttccattgatgcagaacccatgaattttatt

SEQ ID NO: 83 - DNA, 789 bp, Enterococcus faecalis
atggacttacatttaaccgttgatctaaaaaaaacaaagacactcattgacttagccgatcaggcccacttaatcattgaacaaacaactaaattaccgaaaaaagaggcagcgattcttttcttgctaatagataaccaactagttgctttaggacttgctgaagaaaaagctacatataaagaagtttcttttgatcactcgattttattgaaaccgacttgggacacagaacttgcctatttagcgcaagctttcctagatgatgcgaaagaaagtggtttaacattggaagcaaccccaacgacagtcaaaattccgaaaagtgcggtagcgacagtgactaactataaagaaacagtcacctttatcttggaacgttttggctactctctgtttaaaaaaccggcgccgaagaaagccagaccagccaaagcacgccacaaatggacaaaagaagttagccaaattcctttttatattgatactcgacaaagcaaagcaactgttttttggcaaaagcgcaatgaaatgcttattaaagctggcgcgacaatgatgcccgaagcccctttaaataaagacgggtctgtcggtttctccgctagatttggtgaaaaacttcgtgatgaacgcaagggccaatttaaagactttgtcacaacggaagatatcgtcttaaaaagcgttaatgaagtcggcttgtttctctattttgctggaacaaacagctggttagagctagttgatgagaacggcaaaaccttaaatgaatggactgtggtggaa

SEQ ID NO: 84 - DNA, 1074 bp, Enterococcus faecalis
atgaacagatggaaagtatatgcaacggtaatcgcttgtatgttatttggctggattggcgtggaggcgcacgcttctgaatttaattttgcggtcacaccaacaattcccgaaaatcaagtggataaatcaaaaacctactttgacttaaaaatggcgcctggtgccaaacaaaccgtagaaattcagttacgcaatgatacagatgaagacattaccattgaaaatacggtgaactcagcgacaacaaatttaaatggcgtagtagaatatggccaaaacgggatcaaacctgacaaaaccttacgttttaacttaaaagattatgtggaagcaccgaaagaaatcatcttgccgaagcattcccaaaagaccttacctttaaccattacgatgcctaaagattcttttgatggcgtgatggctggcggtataacactcaaagagaaaaagaaagaaacaacgacttctgcggatcaatcaaaagggttagctattaataatgaatactcctatgttgtggctattattcttcagcaaaatgagacaaaggttcaaccagatttaaaattactgggggttaaaccaggccaagtcaacgcgcgaaacgtcatcaatgtttctttacaaaacccacaagcggcctatttaaaccaattacatttaatcaacactgtttcaaaaggaggcgaaacgctttaccaatccgatactgaggatatgcaagtggcgccaaactctaactttagttacccaatttctttaaaaggggaacgattaacgccaggaaaatatgtcttgaaatcaacggcctatggtgtaaaagatgaaaagggcacctatcaagtcaaaggcgccaatggtgaagaacggtacctgtacaaatgggaatttacaaaagaatttactatttctggggacgtcgctaaagaattaaatgaaaaagacgtaaccattaaaggaaccaattggtggttgtatctactgattgcattaatcattctagcgctgctcttattgattttcttcttgtatcgtaaaaagaaaaaagaggaagaacaacaatctgagcaa

SEQ ID NO: 85 - DNA, 972 bp, Enterococcus faecalis
atgagcaagaatttttgggcaacattgccaaagcccttttttgttttagcaccgatggaagatgtcactgatgtggtctttcgtcatgtcgtgaaagaagctggggcaccagatgtgttttttacagaatttactaattcggatagttattgtcatcctgaaggaaaagatagtgtacgcgggcgcctcgtttttacagaagatgaacagccgatggtggcacatatttggggggataaaccggaatttttccgtgaaatgagtatcggcgtagcggagatgggctttcaagggttagacataaatatgggctgtcctgtgcctaacgtggctgagcgtggaaaaggcagcgggctaattttgcgcccagaagtcgcggctgaattgattgacgctgccaaagcaggtggcttacctgttagtgtcaaaacacgcattgggtttactgaaatggcggaaatggaggcgtggatcacgcatttattagagcaagacattgcgaatctatccattcatttgcgaacacgaaaagagatgagcaaagtggatgcccattgggaggtcattccgcaaattatggctattcgggaccgtgtcgcaccgcaaacgacaattacgattaatggggatattcccgatcgtcaaaagggcctagaattagcagaacaatatggtgtagatggcatcatgattggtcgggggatttttaaaaatccttatgcctttgaaaaagaacccaaaacacatacgccacaagaattgctgggcttgctacgtttacaattggatttgcaagacaaatatgcggaattggtgcctcgctccatcgttgggctgcatcgcttctttaaaatttatgtcaaaggctttccaggtgccagtgatttaagagcacaattaatgaatacaaaatcaacggatgaagtgcgccagttgttagcgacgtttgaaacagaacatggtgtgcttgac

SEQ ID NO: 86 - DNA, 1092 bp, Enterococcus faecalis
atgcgttatttagatgcagaagcaattgagaatatagccacaggagcagcttttttagggacaggaggtggcggtgatccctacattggtaaaatgatggctttgtccgccatcgaagaaaacggacctgtcaaactggtttctccagaagaaattgccgcggaggattttttcctacccgccgcaatgatgggtgccccatctgtcgcaattgaaaaatttcccaaaggcgacgaattcgtccgtgtctttgagaagttaggaaaatatttagaccaagaaacgattgcgggaacctttccaatggaagctgggtgcgtcaattcaatgattccaattgttgttgcagcgaagctaggcattcccttggtggattgcgatggtatgggtcgggcctttccagaattgcctatggtaacgttccatttgaatgggatgtcagcgacccctatggcaattaccgatgaaaaaggaaatattggcattatggaaacgattgataatacttggacagaacgtcttgctcgtgttcaaacggttgaaatgggcgccagtgctttagtgagcatttatcccgcgacaggcaaacaattacaagactatgggattcacaacatcgtgacattatcagaagaaattggcaaagtgattcgaggtacctatgcagatgaacaagaaaaacgccaagcattagtagaagttacggatggctttgaattgttccaaggaaaaattctagatgtggaacgagaagtaaaaggtggcttcaatttgggacgtgtcaaattgagtggcttaaacagtgacgctggttcagaagcagtcgtccattttcaaaatgaaaatttaattgccgagaaagatggtcaggtgattgcgatgacgcctgatttgatttgtatggtagatttagaaactttaacgcctgtgacaacagaaagcttgaaatacggcaaacgtgtccaagtaatgggcttgaaagcgaatgccgcttggcgaacgaaaaaaggtatcgaaacagtgggtcctcggtatttcggctacgaaatggattatcaaccactagaaaacttagtagcaaaggaggacaaa

SEQ ID NO: 87 - DNA, 1092 bp, Enterococcus faecalis
gtgacaattgttttattactactattaaatgtctcaattatgttccttttaggacaactacttagtgaaaactcgcccttagctggtgtcatctgggccactaaggatgcggtcgctaaagaattaaatactgatttgttttggagctggaataaatttgtcttacccattttctttttagtagatgcagctgttctctattggcgcttaattcgtcgctaccatcaaatgcaattgcgtcatattatcagtgagttacattacatcgctgatggtaattacaatcaccgcattccgtttgaattaagtggtgatttagcaaaagtcgtgacgagtattaacggtctggtggatagtactgtcgcagccattgaagatgaacggcgaattgaaaaatcaaaagatgaattaattacgaatgtcagtcatgatattcggacaccgttaacttctattattggttatctgggattgattgaagatcgtcaatttcatagccaagaagatttactgaaatatacgcataccgcttacgtcaaagcgaaacaaatgaaattattagttgatgatctttttgaatatacaaaagtccgtcaaccaagtgtaccgattcatacgacgacttttgatatggcacaattaattgaacagcttgctgccgattttgaattggaagcgaaaaagattaatatgcaaatccaagtaaaagccaatccagcttctttaatgatggaaggcgatacggaaaaactagtccgagtctttaacaaccttctttcaaacgctttgaaatatggcaaaggtggccatcatattgtaatggaagtagacaaagtcggcaccgaagcaattattgctgttcgcaatgatggaccagctatccctaaacattctttagatcagttgtttgaccgcttctatcgtgtcgaagaatcccgatcacaagaaacggggggtactggtttaggtctggctattgcacaaagtattgtcgctttacatggtggatatatttatgcgaagtctgatcaaaagtggacttcctttattattcatctacccttacagcgtaccaacaagaaatcagagagt

SEQ ID NO: 88 - DNA, 687 bp, Enterococcus faecalis
atggaagcagaagcattacgagcaatcgtggctgagaatcgtcaattagaacagaatttgactaaaagaaatgaacaatacatttttgacttaaaaaaatcattaaaagcggctaatttatctgaagaagagctagcattggctctacacggtattttgccagaattagtagccggtcaaaaaacaggtaaaacagcccgtcagttatttggcactgtttcagaacggacggaagcaattttaaataaaccagcagaagtcaaagaaccagcgggctggatgatttggctcgacaataccttactattacttggtttattaacaatcatgttagcggcgatgtctctattttcaaaaggaaccgcacaacctctcggattaaccacatatatcttaggtgcgatggctgggggttatgttttctatctaatgcacaaatatgtttaccgttttgatcgtcaaggtggcgacaaaagcaaacgtcctggttggttaaaaacgaccgccattctatttggtgggatgttcttgtggattgcagttttcgctggttcagcgatgctaccaccagtgatcaatcccatcttagatccgatgattgctttagtaatcggtgcgttagcctttgtagcacgctatttcttcaagaaaaaatacaatattcaaggtagtttcatgacacgtcaa

SEQ ID NO: 89 - DNA, 1293 bp, Enterococcus faecalis
atgaatttagttttagccgagattgccgccatggggctgaaaaacatttcgattgcacctagttcaattgcaaatgttcatgaacctctgattgaacacattaaaaatggagtagtcaccaacattacttcttctggtttgagagataaagtaggagccgctatttcagcaggtatcatggaaaatcctgtggtgattcgttcacatggtggccgggcacgggcagtagcagcaggcgatatccatattgatgtagctttcttaggtgcaccaagttcagacgcttatggaaatgcgaatggaaccaaaggaaaagctacctgtggttctcttggatatgcgatggtcgatgcaaaatatgcggatcaagtggtcatcattactgacacattagtaccatatcctaatacccctatcagtattccacaaacagatgttgattatgtggtagaaattgatgcaattggtgatccagatggaattgccaaaggcgcgacacgttttacaaagaatcctaaagaattattgattgctgaatatgccgcaaaaataattacacattctccttactacaaagaaggcttctcattccaaacaggaacaggtggctcttcactagcagttacgcggttcatgagagaacaaatgcttaaagatggcattaaagcaagtttcgctttaggcggaattacgaatgcaatggtggaacttttggaagaaggcttagtagaaaaaattattgacgtccaagactttgatcatccatcagctatttctttaggggaaaatgccaatcattatgaaattgatgccaatatgtatgcctcaccgcttagcaaaggggcggttattaatcaattagacacagctattttatctgctttagaagtggacacagattttaatgtaaatgtcattactggttcagatggtgtcatccgtggtgcttctggcggacattccgatacaagtatggcttgtaaaatgagtctagtgattgcaccacttgttcgtggacggattccaacaatcgttgagcaagtaaatacagtcgttacaccaggtacgagtgtcgatgtcgtagtaacagaagtcggcattgcaatcaatccaaaaagaacagacttaattgattgttttaaaaccttagatgttcctcagtttacgttagaagagttgaaagacaaagcctacaacattgttggcaccccggaaccaattaaatatggagacaaagtcgttgcgttaattgaataccgagatggtagtctaattgatgtggtacgcaatgtt

SEQ ID NO: 90 - DNA, 684 bp, Enterococcus faecalis
atgacgatgaatccttttaaaggaaagcaatttcagcaggatgtgattattgtagccgtgggctactatcttcgttataaccttagctatcgtgaagttcaagaaatcttatatgatcgtggcattaacgtttctcatacgacgatttatcgttgggtgcaagaatatggcaaactactctatcaaatttggaaaaagaaaaataaacaatccttttattcatggaaaatggatgaaacgtacatcaaaattaaaggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatggaagccattcgaggattatataagaaaacccggaaagaaggcactctcttcgggttttcggtctgtactgaaatcaaggtattattgggaatcccagct

SEQ ID NO: 91 - DNA, 1269 bp, Enterococcus faecalis
atgaataaaaaaagaattatctttgggcttctctcttttttcttgcctatatttttagtctttggaggcttacttttttttcttttattattaacgagtacgtcagatacttcaaaaaatgattgtattcagccaagtataaataatccaactgatgcgacagatacacctaaatcgatcgagcagtttgtaaaaagccataaagatgcttaccttttatcatggaaagcaggtggctttttaccgtctgctagtatttctcaaacgatggtagaaaatgggtttaattttactaatccatcggggacgtcattttggcaggcgcacaatatgggcggtgttaaaacgtcaaaaaaagaagattttcctgtaactttagcaacattcggccaagattctgttgatatttctggtacaaagccagggtcaaacgtcggtgatggcactggtggggcatatacctggtttaaagactacaatgctggaattgttggaaaagcagaatttatggcacaccagacactgtatacaggtgctatcaataatactgacggattaagtactttatcagctatttattcaggaggatgggctacagaccctacttacctcatgaagttacaggccacatataatagcttaggcaagcagtttcaatggttggaccaagaagcaatacagaaatatggtaacgcgccgtttaaaaagagcgaacttgtcctaaatattcccggaaaatccccaatcacaaacgaaaaatatggtaaaaattctgattgcgttgttacttcagatacatccgatcaagttacaggacaaaatactgccccatcattagaagtaccaagtgcgtataaaggaaagttaacacttccgcctatcgattcgaatgattacgctggaaataactatccttttggacaatgtacgtggtacgcctataatcgtatggcgcaaattggcaaaccaattgaatggttttcaggtgatggcggaaatggcgcaggttgggctaattctgctcgtgcgaaagggtacacagtagtaaaagtaaaaccaagtgttggttgggcagctagtatgcaaggtggcataggaggttctgcaccgccctatgggcatgtggcagttgtagagtatgtcaattctgacggcagtattcttgtgagtgaagcaaatgttattaatcaaggctctggtacgcgttcatggcgagtattagacagagcaacggttgaacaaattgattttattcaaggaaagggagcg

SEQ ID NO: 92 - DNA, 894 bp, Enterococcus faecalis
ttgaacttacaaattaaaattaaaatggaggaaataatgatgaaaaaaaatctttttgctagtttatttagtgccacactactatttgggggaagtgaaatttctgcttttgcacaagaaattatccctgatgatactacgacaccgcccattgaagtaccaacagaaccaagtacaccagaaaagccaacagatccaacaccgccaattgagccacctgtagaccctgtagagccacctattacaccaacggagccaacagaaccgacagagccgacaacaccaacagaacctgaaaaaccagtagttccaacggaaccgacaacaccaacagaaccgacaactcctacagagccaagtgaaccagaacaaccaacggagccaagtaaaccagtagaacctgaaaaaccagttacaccaagcaaaccagcagaacccgaaaaacctgtgacaccaactaaaccaacagaacctgaaaaaccagtacaaccagcagaaccaagcaagccaatcgacgttgttgtaacgccaacaggggaattaaatcacgctggaaatggtacacaacagccaacagtccctattgaaacaagtaatttggcagaaatcacacacgtgccaagtgtaacaacacctattacaactacagacggagaaaacattgtagctgtagaaaaaggtgttccacttacacaaacagcagaagggttaaaacctattcaatcgagttacaaagtattgcctagcggaaatgtagaagtaaaaggtaaggacggtaaaatgaaggttttaccatacacaggtgaagaaatgaatatctttttatctgccgtaggcggtatcttgtctgtagtatctgggtttgtcatctttaaaaaacgcaaagctaaagta

SEQ ID NO: 93 - DNA, 3888 bp, Enterococcus faecalis
atgaagcaacaaacagaagtaaagaaacgttttaaaatgtataaggcaaagaagcattgggtggtagcccctattctttttataggtgtgttaggagttgtaggattagctactgatgatgtacaagctgcggaattagatacgcaaccaggaacaacgacggtgcaacccgataaccccgatccgcaggtaggtagtacaacacctaagacagcagtaactgaagaagcaacagtacaaaaagacactacttctcaaccgaccaaagtagaagaagtagcgtctgaaaaaaatggagctgaacagagttcagctactccaaatgataccacaaacgcgcaacaaccaacagtaggagcagaaaaatcagcacaagaacaaccagtagtaagccctgaaacaaccaatgaacctctagggcagccaacagaagttgcaccagctgaaaatgaagcgaataaatcaacgtccattcctaaagaatttgaaacaccagacgttgacaaagcagttgatgaagcaaaaaaagatccaaacattaccgttgttgaaaaaccagcagaagacttaggcaacgtttcttctaaagatttagctgcaaaagaaaaagaagtagaccaactacaaaaagaacaagcgaaaaagattgcgcaacaagcagctgaattaaaagccaaaaatgaaaaaattgccaaagaaaatgcagaaattgcggcaaaaaacaaagcggaaaaagaacgctacgagaaagaagtcgcggaatacaacaaacataaaaatgaaaatggctatgtagcaaaaccagtaaataaaacgctaattttcgatcgtgaagcaacaaaaaattccaaagttgtttctgtaaaagctgcagaatatatagacgctaaaaaactaactgataaacataaagataaaaaattacttatcagtatgcttagtgtagattcaagcgggttaacaactaaagactcgaaaaaagcacatttttattataataacggtgcaggaggaacattggttgttcttcacaaaaatcaaccagtaactattacctatggcaatttgaatgctagttatttgggtaaaaaaattgctagtgctgaattccaatatacagtgaaggccacacctgattcaaaaggtcgattgaatgctttcttacatgatgatccagtggccacaattgtctatggaattaacattgaccctcgtacaaagaaggctggtgctgagattgaaatgctcgttcgcttctttggagaagatggcaaagaaatcttgccaacgaaagagaatccatttgtattttcaggtgcttcattaaattcacgtggtgaaaacattacgtatgagttcgtaaaagtaggaaacacggatactgttcatgaaattaatggatcaaaagtagctcgtcatggaaataaagtttattctaaaacggatattgatgtagggacgaatgggatttcaataagtgactgggaagcagttcaaggcaaagaatatattggcgcaactgttatttcaacaccaaatagaattaaattcactttcgggaatgaaattgttaacaatccagggtatgacggaaattcgatgtggttcgcatttaatacggatttaaaagcaaaatcaattacgccttatcaagaaaaaggacgtccaaagcaaccagaaaaagcaacgattgaattcaatcgatacaaagccaatgtggttcctgttcttgttccgaataaagaagtcactgatggccagaaaaatatcaatgatttaaatgtgaaacgtggcgattctttacaatacattgtgacaggggatacgacagaacttgccaaagtagatccaaaaacagtaacaaaacaagggattcgagatacctttgatgcagaaaaagtgacgattgatttatccaaagtgaaagtttatcaagcagacgcaagtctaaacgaaaaagacttaaaagctgttgctgcagcaattaattcaggaaaagctaaagacgtgaccgcttcttatgaccttcatttagaccaaaacaccgttacagcaatgatgaaaaccaacgcagacgactctgttgttttagcaatggggtataaatatttacttgtcttgccatttgtagtgaaaaatgtagaaggcgattttgaaaatacagctgttcaattaacaaacgatggggaaacggtaacaaatacagtgattaaccatgtgccaggtagtaatccttccaaagatgtaaaagcagataaaaacggtacagttggcagtgtttctctacatgataaagatattccgttacaaacaaaaatttattatgaagtgaaatcttccgaacgtccagccaactatggcggaatcacagaagaatggggcatgaatgatgtcttggacacgacccatgatcgtttcacaggaaaatggcacgctattacgaactatgaccttaaagtaggggataaaacgttaaaagcaggaacagatatttctgcctacattcttttagaaaacaaagacaataaagacttgacgtttacaatgaatcaagcattattggcagcgttaaatgaaggaagcaataaagtaggcaaacaagcttggtctgtgtatctggaagtcgaacggatcaaaacaggtgacgtagaaaacacgcaaacagaaaactacaacaaagagcttgttcgttctaatacggtggtgacacatacgcctgatgatccaaaaccaaccaaagccgttcataacaaaaaaggggaagacattaatcatggaaaagtggctcgtggtgatgttctttcttatgaaatgacttgggacttaaaagggtacgataaggactttgcctttgatacagtcgatcttgcgacaggcgtttctttcttcgatgattacgatgaaacgaaggtgacaccaatcaaagacttacttcgtgtcaaagattctaaaggggaagacattacgaaccagttcacgatctcttgggatgatgccaaaggcacggtgacgatttctgccaaagacccacaagcctttattttggcgcatggtgggcaagaattacgtgtaactttaccaacaaaagttaaagccaatgtttctggtgatgtgtataatttagcggaacaaaatacatttggtcaacgaattaaaaccaataccgttgtcaaccatattccaaaagtgaaccctaaaaaagacgtggttattaaagtcggtgataaacaaagtcaaaatggtgccacaatcaaattaggggagaaattcttctatgaatttacaagtagtgacattcctgcagaatacgctggtattgtggaagaatggtcgattagcgataaactagacgtcaaacatgacaaatttagtggccaatggtctgtgtttgccaattctacgtttgtcttagcagacggaaccaaagtgaataaaggggacgacatttcgaaactattcacgatgacctttgaacaaggggtagtgaaaatcacagccagtcaagcctttttagatgcgatgaatctaaaagaaaacaaaaacgttgcacactcatggaaagcgttcattggtgtagaacgaattgcggcaggagacgtttacaacacaatcgaagaatctttcaacaatgagaagattaaaactaatacggtagtgacgcatacgccagaaaaaccacaaacgccaccagaaaaaacagtgattgtaccaccaacaccaaaaacaccgcaagcaccagtagagccattagtggtagaaaaggcaagtgtggtgccagaattgccgcaaacaggcgaaaaacaaaatgtcttattaacggtagctggtagtttagccgcaatgcttggcttagcaggcttaggctttaaacgtagaaaagaaacaaaa

SEQ ID NO: 94 - DNA, 432 bp, Enterococcus faecalis
atgaaatatgaacgtccattaaaaagagagtcacaaatcaaggagtttgagttaggcacgcacgcggcagtaattgaaaaagttcaaaagaaacggtctcaaaaagggaatgatatgtttttactctctcttttgggaaaaagtaacgaaaaaggggtttattttcttaccttcgggaatgattatactgaagataatttacgctatattttagccagtatccaagacaacggtgtagagattccagacgttgactttggctataatcgagaaacttttgaatttctgaaaggtaaagatgtctatattcaggttgaagaacaagagtataaagggaaagttaaacatgcggtaacaaattttttaactcaggatgaatttgaagaaagcgaagaaatggagttttcagaaagcaatactgaagaagattgg

SEQ ID NO: 95 - DNA, 486 bp, Enterococcus faecalis
ttggtggaacaaagagaaattgtacaccgctattatgttttaggtactagtactttagataaagtattaaaagtgctgcttaatttatccagtgatggtgtattggcgctaaaagacaagtttcttcctttaaaaggggaaaataatttgtataagctaatgaatcgtgaggatccactgacttcggcgcaacttcatgaaaaagtgaatttaaataagttaaaagaacagttggaagcccaagggcttccttttgcgtttaaagaaaccaaagaagggactaacttctattttcgagtaaaagatacggaactcgcaaagaaagccttagaacgcgtattaacggatattaagaagaacccacaaatgattttgcgtaagccaaataccatgacttttgatgaacggttagcctacactgcagccaataaaaaatacgtgggtaaaatcgatcaaacaaaagcaatcacaaaaggaaggaaactg

SEQ ID NO: 96 - DNA, 1341 bp, Enterococcus faecalis
gtgcgtatgaataaaaaaacaccaaaaccattaaccccacccaaagccttttttaactggtgtactgcacaaatacccacgtatgaatggcaaaacaaaaaggagacaattcttgcgagttctcgcaagaattgccctatcataaaaaaacgattaacaaaatactcacgattatcgtttccaacgaaattttactcctttggaatcattctcgttcgtgcaaaacgaattgaaattcaaacccatagttattggcagacgattacagatggaatagaaaaccttatctatgagccgtcaaaccttgaacggttttcaaacgatacccatgttaaagcccattatgagaacggacattggcatgagggcttgttagcaaattatggttttatgagtagtgcttatacaaatacagtattctatccaaataactggcaagaaaaactaaccactgtatcggaattaaagtacttacagttacctgaaatagaacgtcaagaactagctcatatttacaaataccgaaacgaaattgagtttttacaaaagataggtgccacaaccttagcgaatgaaatcatttttgacgactatcgcaacgtttttggactgtattttcataaagtagatatgagagtaattactaagaaatggctaaaagcgaataaacaaaaattaaaaacaagaaatccaacctttcatgaattcatgttagaaaaaacgttaaaagagcgaaatgcgcctatgataaacgaaatagaaaagtacgtgcattattcgcaaattaagcaactaccgaaagaagtgaacttaacaaagtttcaaaaatggtttatacgaaaaggggagcgttttgactattatatggactatttacacatgttagaagagttgaacaccccacttaataacgatagtgtattgtatcctgaaaacttacaagtagctcacgataacgctatgaacacgctaaaccttttgaaaagtgagattgaagaaaagcagtatcaagaacggaaaaaccaaattaaagcgttagaagctgaaattgacgatttgctttttctcacaccacattcattacaagaaatcattcaagaaggaagtattctacgccattgtgtgggcagtcaacactatatcgaacggcatacgcaaggaaaaacaacgattgtttttatccgaagaaaagaaaagccagatatgccttacttcacattagaatatcgaaatcaacaggttatacaaatacaaggaaaatgtaaccgtcaggaagtaccagaaaagataaaacaagcagtcagacaatggcaagagaatttacagcacgccttatcatca

SEQ ID NO: 97 - DNA, 87 bp, Enterococcus faecalis
ccaagtgaaaagggaaaccaaggaagggttgaaaagagaagcgacgcaaaaagtacgaaccacgttaacgcaggaagatacactgaa

SEQ ID NO: 98 - DNA, 213 bp, Enterococcus faecalis
gagaacgaattcaagctgcacaaaattggtttacattcttttctcgatcgggtacaccaatcggtggttctgggagtgaggtctttgcgcagtataaagaaaaaatgcaaccattacccacagacagagaaacaaaagcaggacaaggctggccaggcaatgcgtatgcgccagggaattgtacttggtatgtgtttaatcgttttgcacagt

SEQ ID NO: 99 - DNA, 192 bp, Enterococcus faecalis
aacattttttccaaaagcagtgctcctattattcggcgcttcattaggtcaatggctaggtgggatgtttgctttcttgatgataggtcgcttgatgcaggtgccagtttcgatggtttctgtttacccaatgtttgttatcgctacgttgattgggatgttaactatggttcctggtggtatgggaacgtt

SEQ ID NO: 100 - DNA, 204 bp, Enterococcus faecalis
aggggaagatgttacatatttaacgaagttcccaggtgttggcaagaaaacagcccaacaaatgattttagatttaaaaggaaaattaggcgaattagagtcttccgaagcagcggttgcggccatgaccgcaaccgaagcggtgacaacaagcaatcaagcattggcagaagcgttagaagcattaagtgccctaggctacag

SEQ ID NO: 101 - DNA, 72 bp, Enterococcus faecalis
accagattgtggggaagacagctatgtcggaaatcacaaattagaaaatcgtcgggtattaattacaggcgg

SEQ ID NO: 102 - DNA, 96 bp, Enterococcus faecalis
cttggtttgtcatttataaaacacgttttggcttacggttacgttctgtgggggaacatccacaagcggcagatacattgggaattaatgtctact

SEQ ID NO: 103 - DNA, 111 bp, Enterococcus faecalis
cacttggttttcgtccatgtaaaagatgtcaaccaaccgggcaagtcgttcctaacgaggaatgggttgctcaaattaagcaatttattgatcggcattcagcggaaccat

SEQ ID NO: 104 - DNA, 189 bp, Enterococcus faecalis
aagacggtagtggcgcggcagctgcgatggaaatggcgattgcagaagcagggattacaccggaacaaattgggtatatcaatgctcatggtacgtcaaccccagcgaatgacgctgcggaaacaacggccatcaaacgtgtctttggtgagcgagcatcgcaaattccaatttcaagtacaaagagta

SEQ ID NO: 105 - DNA, 60 bp, Enterococcus faecalis
tgctacagcaaatttaggcaaacatcaaaacaatggccaaacaagaggcgacaaggcgac

SEQ ID NO: 106 - DNA, 120 bp, Enterococcus faecalis
gtggctagtccctcgaaaagtgcgccattttttacgcacgcgaaaaaatgtcaaaatcaacggagaaacagctgcttttcattttccagtccaagctggcgattgtgtcaccttaacgtt

SEQ ID NO: 107 - DNA, 207 bp, Enterococcus faecalis
aacaaggggcggcagccaatttacagaaagctccagcgcgcacctttgatcctaaagtatttaagcccagcgcaagtaaaccagcttatacacaaccagctacaaaatcagttagcaacaaagtggcaagtggtggcgaaaaagtttcttggcaagcaggtgataaggtccaacataaagcatggggcgttggtacagtcgttcgtg

SEQ ID NO: 108 - DNA, 210 bp, Enterococcus faecalis
gagagcatcaaggatttcaacaacgtttccagaaaaaaacagataaaaagagtccaatcaaaatggaagattatcttttactcagtcgtcatttcactggactcagccgtgaaacctatcgggaagttctccgatattttcaaagaggcgcttttcagcaatactactccgaagaccaagaagtcatcagtcaaagaatacgtgaaaatt

SEQ ID NO: 109 - DNA, 120 bp, Enterococcus faecalis
cacctgtggttggtgctgcggtacctgcccaagcagaatcaagccagcaagcatttattaatgaaatcggaaattcagcagcagccgttgccaatagcaatgatatgtatgcttccgtca

SEQ ID NO: 110 - DNA, 162 bp, Enterococcus faecalis
gtcatgtttcggcaaaatcacaggcgcgacaagaagaaaaagaggcgaagcgagcagcgaagaaagaagccaaagctgcagaacgccaagcaaaaattgaagccgctgcccaacaaaaattacaagagcgggaacgcatggaacaagcggcagccgagcgct

SEQ ID NO: 111 - DNA, 192 bp, Enterococcus faecalis
aggattgcgaattggaatttggaatatacgaataatttggaggtaatacttttgggtaaaaaaggttcaaagattaaaaagaaaaaacgccgacttaaagaaaaagctattgcaaatggcacatacagcaagcgagggaaaagcgatggtatgtataaaatgcaagggacagatgattgtttgggaaaaaga

SEQ ID NO: 112 - DNA, 120 bp, Enterococcus faecalis
aaaacgaatacggcattggcgggcatggctacattggctatgatgaatggcacgacggcaaaggcatcaagctgtcccgcgccgacgatttttccggtggcaattatgatacggttacgc

SEQ ID NO: 113 - DNA, 81 bp, Enterococcus faecalis
cgattgcccgcgccgccgctgaggaaaacccgcagtttgccatcaatgccgaaaagctggaacaggtgcagcccaaagacc

SEQ ID NO: 114 - DNA, 237 bp, Enterococcus faecalis
ggaggtggaacccatttgaaacaatatgaaatcattctggccgaccctccgtggagatactcacaaaaggggggtgcagggagcggcagaacgtcactacgccaccatgagcatggaggatttatgctcactgcctatcagccgttttgctgcgccggactgcgcgctttttctttggagtacattcccacagcttccagaagcactgcatctgattcgtgcatggggattcaccta

SEQ ID NO: 115 - DNA, 216 bp, Enterococcus faecalis
cgaaaacaattgatcacagtcgtttacaagtcaaagattcaacgatttatgtcggcgattcatggaaaccagaagagaactttgtttcagcaacagataaaacaggtcaagacgttcccttcgaaaaaatcactgtttcaggtcaagttgataacaccaaagcaggcgtttatccaattatttacagtgacgaaggtaaagaagaaacagcctatg

SEQ ID NO: 116 - DNA, 126 bp, Enterococcus faecalis
caggaattacggatagtggttatacagatacaaataaaccagaaacggatacgccagcaacagatgcaggcgaagaaattgaaaaaatacctaattctgatgttaaagttggcgataccgtcaaag

SEQ ID NO: 117 - DNA, 96 bp, Enterococcus faecalis
ttatcatggcaaagcagtgcaagcagaagatgttttggaaatcgtgacaaatcaataccgagcagtcggtggcggaaactatcaaatgttccaacc

SEQ ID NO: 118 - DNA, 195 bp, Enterococcus faecalis
agaaacacgcaagggaaatgccgattttccttgcgtgtttcgctgtttttcggtaaagtatgtagaaaagtagggagttttgctcatgaattatccattgatttttgcagaaaaccaacgaatcgaaaccgaacgcttgattttaaggcccgtcacattagccgatgcagaggatatgtacgaatatgcttcaga

SEQ ID NO: 119 - DNA, 141 bp, Enterococcus faecalis
tttcccagcggacttcttttcgccagaggaaacgttggcgctggttccgcaagcggtgattcaagcattcgcggaacagttgaacacgccacttttaacggcagccgaacaagcggcggcaccgaatctgctagaagcatt

SEQ ID NO: 120 - DNA, 222 bp, Enterococcus faecalis
aaccaacggaagaaattcaaccaaaaccagaatcaatcacccctcaggaaaagtcagaaccggaacaacctgcgccaacccctccggaagatcaaaaaactacggttccttctgaagaaaaaaagccttcacccaagaaaaaagacaaacctgtggagaaaccggcaatgtcaaaagaaaaaaagaaacaaacaaaagaaacaacggctcatcccttacaag

SEQ ID NO: 121 - DNA, 84 bp, Enterococcus faecalis
caacaagtttgtttggcgcctttgtcgcactccttgcgagcatgggaatcatcaaacgcaaacgtaaaaactagctctctcctt

SEQ ID NO: 122 - DNA, 195 bp, Enterococcus faecalis
gctgttatgcacgaccaaaagacaaaccgacagcccttgacccaatcaacgaagaagaagccaaagaacaagcaaaatatgcggtcaatggtttccctcaagattttacagaatggtacgagtgggaaattaacaatggaaaacttaaaaatttactataaaaaaagaaaccttttgctaacgacaaaagatttc

SEQ ID NO: 123 - DNA, 192 bp, Enterococcus faecalis
ccaaactcttgtgtataccacatgaatgaccaacgaattaagttccaagcaacgaagaataagattgggcctaagatgttaccacccattgctaaggaagcacctaaagcgcctaacattggacgaacagtaaaccagaaaactgggtcaccgacaccggctaaaggacccatcatcccaactttaacccct

SEQ ID NO: 124 - DNA, 153 bp, Enterococcus faecalis
attaaatgtccgaccagccgtcagctgaagcatttcttttttcatgccttccgccaaacgtgcatccccaaagctttcaatcatatcaataacggcgattacttctttataatatctcattttgccagtgtacagataatacgtaaggttttt

SEQ ID NO: 125 - DNA, 84 bp, Enterococcus faecalis
cgccatatcagtaatgggggcaccttccttgcggttactgaaatggccattgatgactttgatagccgaactttccaaattttc

SEQ ID NO: 126 - DNA, 102 bp, Enterococcus faecalis
tccacactttcaataatcgctttaatattttctaaacattgcgtcgtttgttccttgattccgccagcgactaacgcatttgttttagggtccaatggtagc

SEQ ID NO: 127 - DNA, 270 bp, Enterococcus faecalis
aacaagtccagtgctttttcaccagctaagcgatgtccccctttaaccacgacatgcttggctcccatttgtacaattcgttttgccgcttcttccatctccgccacggaagaaatttcgcctaaaccagataagatgcccgcttcaattaaattaggcgtggccactaatgctaatggcagtaaatcgttttttaggccttccacacttttgggttgcagaatttgtgccgttcccttacaagcaatgactgggtcaatcacgactttt

SEQ ID NO: 128 - DNA, 144 bp, Enterococcus faecalis
ttgccgttggttgtttataatgaatcaaatcgcaaaatggatgcacttgaaaactcgtgccgacaatcacgattaagtcggcagaagcaacggcctgaatggctttttcaattgcctcttcggatagtccttcttcatacaaag

SEQ ID NO: 129 - DNA, 267 bp, Enterococcus faecalis
accagtaatgacagcatcatgattgctaaactaagcaacagttttttcaaaaagtttcgttctcgaacaaaacaattaatcgctgcatccgattgtcggactaaaacgaataacgtcgctagtaacccaagaatagtagaccaactagcacctaatgttccccaacgaatggtgaaaaagcccgttgtcagtaacttcactaataagcccacaccagctgccactaaaggacctttaaaacgattgcgactttgttcaatactttgg

SEQ ID NO: 130 - DNA, 216 bp, Enterococcus faecalis
tcagctttaatgtctactacacggccttctggtttatctaataaggtaacaattttcacagatgcagctttacggtatctaaacaaatctactaaatacgctaatgtacgaccactatcgatgatatcttctacgattaaaatatgtctaccttcgacatttgtgtccaagtctttgacaatttttacttcgcctgaagaaactgtcgcgttgccg

SEQ ID NO: 131 - DNA, 111 bp, Enterococcus faecalis
cacgtgttacagaaataccaacgcccgcaatacctacgctatccgcggaaaattgagccatttccccagtttgtaatttgctttctggaatttcaaccaatacaaaacctt

SEQ ID NO: 132 - DNA, 366 bp, Enterococcus faecalis
atgtcaataatcacaccagcagatacctttttgaatcgtttaatcaacgtagctgctgactctttcaagccatttctttctaacgttcctgttgctaacataataataataaagatagccatgcctcgattattcacaaaggttgttcctagtgtttctagcattgatgtcaaaccaagcccgccagtaaaagccgtcactattaaagcaaccatcacaatcaagatagcatcaaatttcaatgcgaagccgacaatgacgatcaatacgcctaataaaggtaataaatccatcaaatctctccttcttaaaataaaatttcactttccattatatgccaattttcgctcatttgtaagacttttt

SEQ ID NO: 133 - DNA, 120 bp, Enterococcus faecalis
cggctaaatagatcggttctttcgttggttcctctgcttgcagtattaggcgataaacaaaaaaatcaccttgcgttttttgtaaaagctgctgctgtaagtagcttaatagttcaccat

SEQ ID NO: 134 - DNA, 81 bp, Enterococcus faecalis
agtgtgtgtattgctcgccacctgccacatttggatgaactcggtcatcataaaaccaatcatcatgggcgttactataat

SEQ ID NO: 135 - DNA, 174 bp, Enterococcus faecalis
gttgcaccaaacaaggtatcaggacgggttgtaaacaccgtgaaactttcttctgtgccagcgactttaaaggtcacattggctccttcagaacgtccaatccaatttcgttgcatatctttaatactctctggccaatcaacaagctctaaatcttctaataagcgatctgca

SEQ ID NO: 136 - DNA, 234 bp, Enterococcus faecalis
atgattcctgcatccataaaaatgacacggtccgcgacttcttttgcgaagcccatttcgtgggtaaccactaccattgtcatcccttcaatagctaaatttttcataacggatagcacttcgcccaccatttcagggtctaaggcagaagttggttcatcgaacagcatcacgtcagggcgcatggctaaagcacgagcaatcgctacccgttgttgttgcccaccagaaagt

SEQ ID NO: 137 - DNA, 243 bp, Enterococcus faecalis
cataatcccatgaaaattgaagcaaaaaatgctggaatcgcatcttctaaatccgtccaattgatgtctttgaaagaagctaacatcataattcccactaaaattaacgctggagccgtagcttgtgctggcacaatagcaataagtggtgaaaaaagactacttagggcaaatagaattgctaccactaccgatgtcaaacctgttcgaccacccgcaccgattcctgctgcactttctaca

SEQ ID NO: 138 - DNA, 201 bp, Enterococcus faecalis
tattttttcgtaatttctacgaagtattcatctaacaacaagttttcaagtgctggatttttttcatatgcatcggtaattttttgtaagaattgtgcacggataatacaacctgctcgccagatttttgcaatttcaccaaatggtaaatcccatccgtattcttcagaagctgcacggagttgtgcaaaaccttgcgca

SEQ ID NO: 139 - DNA, 75 bp, Enterococcus faecalis
ccatcttcatcaatcaatgtgacttttgtcgttgtggagcctgcatcaatccctaaaaaggtcacgccagtatgt

SEQ ID NO: 140 - DNA, 198 bp, Enterococcus faecalis
gcaataataaacgatgtccgtcctttcagaagttgttgtagtccttcttgtaacaattcttctgtttttgtatcaatactggaggttgcttcgtctaaaattaaaattttgggatctgccagtaaagcacgagcaaatgaaattaattggcgttgtcctgccgagagtgtactaccccgctcttccacaactgtttca

SEQ ID NO: 141 - DNA, 129 bp, Enterococcus faecalis
tcttcctcttctggaaacacttgtggccaaaaagattcagctagccaaaataattgctctgttacagttcctttaaacttaggaagttcgtcttcagccaagggcaaactcgcaacttcagctgccgta

SEQ ID NO: 142 - DNA, 144 bp, Enterococcus faecalis
atcatccccgcttcaacaggtgaatgtaaagcatcgatgccaaacatagttaaggccaatgcaatcgccaacgtatacaacaaattaatgatgggacttaataataacgaattcatacgaatcattgctactcgtgtttttaaa

SEQ ID NO: 143 - DNA, 96 bp, Enterococcus faecalis
actaattgcattgctacgccacaagcgattcctaattttaaatctcctaaaataatgccacaaactaatccgccgactaaaggacgcccaatcgta

SEQ ID NO: 144 - DNA, 111 bp, Enterococcus faecalis
tacccattccaaatagacaaatcaacgccttggtctccttttgcagcaaatgtgctaattggtgatacaaaaaataagactaccagtaacgttgccaatagtttctttttc

SEQ ID NO: 145 - DNA, 165 bp, Enterococcus faecalis
ttttttaatgatttaagaatatccataatcactttttcactagacatatcaatgccgacgaaaggttcatctaaaaaaatcacctcagcaccttgggccaaaacacgggcgataaacacacgttgtaattggccaccagaaagttcgccaatctggcgttgcgca

SEQ ID NO: 146 - DNA, 66 bp, Enterococcus faecalis
tttttacacaagagtcattgtcctgtagaaccgaaaaaaacagttcctgtgccttcgttaatttgt

SEQ ID NO: 147 - DNA, 66 bp, Enterococcus faecalis
gacacaaattgctgtgcaaacagtgttgccgttacaccgacaagcagtaacaggacaatgatcgta

SEQ ID NO: 148 - DNA, 129 bp, Enterococcus faecalis
gggtcgccgtcatcgtcataccgggtttccacgatcacctcacgggtgagggtgtactgccgggaaaaaatgcggtcaatttcgggctggacttctgcaaaggtaaaagcattgaacgccgtggagagg

SEQ ID NO: 149 - DNA, 81 bp, Enterococcus faecalis
ttgctgtgccactattgtttcttcctgattccacagtgtgatagaaacaacagggacagtttgtgccacgtccttggttcc

SEQ ID NO: 150 - DNA, 339 bp, Enterococcus faecalis
aagacaatcgcaaaggttaataatgcaactaaccaattccgggctgaaccaaaatcagcactaccagctcctcctgccatatacttaatcgcaacaggaaacaaggatagtccaatgcttaaaataaccgttcctgttactaaaggcggaaacaacacacggatttttttaatgaacaaaccaacaataataacaagaatactgccaactaattgggaaccaaaaattgctgcaatcccaaaatcagctccgatggccatcaaaatcggtacatacgcaaaacttgcccccatcataactggtaaccgtgaacccacttttccaaaaatagggaaaagt

SEQ ID NO: 151 - DNA, 96 bp, Enterococcus faecalis
ccaacactcatattaaaaatgaaaccattcgggtcacctagctcgaactctttactaagtaacttcaaaacgaaccatgctttgacgtattcatca

SEQ ID NO: 152 - DNA, 309 bp, Enterococcus faecalis
ggaacactatcaatcacagttgcaccagtatgcaccatgactgctgctgaaagtgaagatgtgcccatatctaaaatcgctggtccaaaagaacctgtcgctaaaataaccgctgtggatgttgaaccaactgctaagcccattaaaataccagaaatcggtgccaagaaggttccagaaattcccataacagaaattaagtggacaatttgtgttgataaatcagaaacagaaattaatccagcaattgcacctgcaccaattaaaattaaaacggtatcggttactctcttcaagccagaagatgca

SEQ ID NO: 153 - DNA, 186 bp, Enterococcus faecalis
actaaatcacgtgctaacgtggatacattacaagaaatatacaccattttcttaggtggttgtttcaaaagggccgttaataatttacgatccaaaccagtccgtgggggatcaactacaatggcatcaggtttaaagccttctttgaaccatttaggtaataagtcttcagctgttccaacagca

SEQ ID NO: 154 - DNA, 150 bp, Enterococcus faecalis
ctttcctgtgaaactaaaaagtccacggggccatcactgttgaccgtgtgcatactaatcgtatacacaaaaaccatcacgccgatcccactcaaggctgtcgcaattaataaggtcaaaccagtgagtgttttgctacttttaaataag

SEQ ID NO: 155 - DNA, 156 bp, Enterococcus faecalis
tttctcttttcacttccggtaaggcgtgaaccaccactaaaattccataaacaaagttcggtgctagccccttttgttccaataacaacaataattcttcaaaatcaacacctacagcaaaagctagtcctaaaccggcaaaggcatacgttcggc

SEQ ID NO: 156 - DNA, 108 bp, Enterococcus faecalis
aataaaccagcaaaaaacgcgccaaaaacggcacctgttaacgctaatggcggaatacctaagaatgtcatacggattaagccgcagacaagtgccatgagcgttccg

SEQ ID NO: 157 - DNA, 180 bp, Enterococcus faecalis
ataaattcccaaatagcgccaatgcccataaattgcctcaacctgtgcgccgatataataaagagtaaccatattcaaaataatatgcataaatccaatgtgaagaaacattggcgtgataaaccgccagtattcatgattttgagctaccagtggacgaaccattgctccccaattaac

SEQ ID NO: 158 - DNA, 66 bp, Enterococcus faecalis
ttttcgttttcgctttacgaattcccgcataaaaagcggcaaataatccaacaggaccgccgccga

SEQ ID NO: 159 - DNA, 285 bp, Enterococcus faecalis
gcaaagaatgcattaattcctaaagctggtgctgtcgcaatcggatatttcgccaacacacccattaaaatacaacctaaggcactcgctaaagcggtggcagtaaaaacagcgccttcgtccatgccagaagcaccaagtacggttggattaacgaacaaaatatacgccattgagataaacgtggtgaaaccagctaacatttctcgtttcatattcgtattcaattgttcaagttcaaaatatgaacttattttttctttcatgttccgtcctcctaaaatc

SEQ ID NO: 160 - DNA, 270 bp, Enterococcus faecalis
cttttttcagatacattctctatttccctcaccgcattcgtttctttaaattcaatcattggaaatagccgacgcaattccgattgcaaaatcaacgaagaactgataccactgggacaaacaattagcgcttttagcttttcttgccgctgttcatttttttgcccgaaaatttctccaccaaataatatggtaaaaaaaccgatttcctctgacgggattgaccgtttcgttaatttttctaaaggagctaacgcttgttcacaaaga

SEQ ID NO: 161 - DNA, 84 bp, Enterococcus faecalis
ataaattcccatagcatacaacgtgttattcgggtcccatgtccaaaaagctcgtctggttctaaaaaaagttccagcgtcagt

SEQ ID NO: 162 - DNA, 192 bp, Enterococcus faecalis
gtaaatcaatgtctgaaacgacaaatttatcgccatatttttttgatacatcactcatctggatcatgtgcgttgcttcctttctgcaataattttccatataaaataaacgcccccaacaaattgaatcaccacactgagcggggtattcaaatgaaagacctgttcaaccatcaattgaccaaacaccag

SEQ ID NO: 163 - DNA, 525 bp, Enterococcus faecalis
tcggccatctcaattttttctgttccagagctgatgtataaagtaacagatcggccttttttcacagatgattttgcttcggggtctgttttgaccaccttgccttcttcaatcttatcgtcgggaatttttttggtttcactatcgactttcagcccggcactttttagcgcttgtgaagcgtccgctttcgtttcatttgtaacatcaggaacttcaacgtctttaccgcccgacattgcaaaggctaagccacctattgctaaagaaattaatgccgcaattgctaagccaatccacaattttttacggtttttcttcggcggttgttcagctaaaatgtcatctgcgatatcttctgggacttcgacaggcgttgtctcttccggttcagcgatgtcttcgggaatcggagttaatactttcgtttctcctaataaagccgttggttcccacgcaggttcgtttaaacgactggctgacaaggacgtgtataagtcttctgccatctcattcgctgttttg

SEQ ID NO: 164 - DNA, 72 bp, Enterococcus faecalis
ggatcaccgccacctcctgtccctaaaaaagctgctcctgtggctatattctcaattgcttctgcatctaaa

SEQ ID NO: 165 - DNA, 75 bp, Enterococcus faecalis
tctccagcaattactgcgcctaatgcaaaagaaccgacagtcattgaaagacctgacataaagcttcctgctgtt

SEQ ID NO: 166 - DNA, 204 bp, Enterococcus faecalis
attcgttcccgtaatgatcgcttagctagcgggacactgatttccttctctgtaaaatgcaacactagtgcaaacaaaatggaaaagccaatgcctaataacatacagccactcatgaacggaatttttgctagcggaatgctcgtactggcacccatcgctgtcaccatcacaccaaagaaggcccctggttttgaaatatcg

SEQ ID NO: 167 - DNA, 261 bp, Enterococcus faecalis
atgtttgtaaacattggcatgaacccaattttcattgacagaaaggcaatcaagaccgatacaatcggcgcgaccgcaatcggaatcaataataaagggttaaaaataactgggagtccaaaaatcaagggttcattaatgttgaaaaatgctggaacaaacgaaattttcgacatggctttcattctagatgaatgtccgacgatggccattgcaatagccaagccaatcgtgcaaccagcgcctccaattgtagcaaat

SEQ ID NO: 168 - DNA, 81 bp, Enterococcus faecalis
caagccaactcggttcgtcccatgaattcccatgcgcacctacaggcggattcaaataatccccttctgcacgttttggat

SEQ ID NO: 169 - DNA, 120 bp, Enterococcus faecalis
gtaaaattaccagtaccatcattcgaaatatcttgtgctttttgttcaagacttgcgcatcctgataatagcaaagtggctgctgttagcagtagccacttttttccaataaatagtttc

SEQ ID NO: 170 - DNA, 366 bp, Enterococcus faecalis
gtgatccaacaagaaagtcgtttaagagtcgctgacaattctggcgcacgtgaaattttaacgatcaaagtcctaggcggatctggtcgtaaaactgctaacatcggtgacgttattgttgctactgtcaaacaagcaacgccaggtggggttgttaaaaaaggtgaagtagttaaagccgttatcgttcgtacaaaatctggcgctcgtcgtgctgacggttcttacatcaaatttgatgaaaatgctgcggtaattatccgtgacgataaaagcccacgcggaacacgtatcttcggaccagttgcacgtgaattacgtgaaaacaacttcatgaagatcgtttctctagcaccagaagtatta

SEQ ID NO: 171 - protein, 330 aa, Enterococcus faecalis
MVGIILASHGEFAEGILQSGAMIFGEQENVKAVTLMPSEGPDDVKAKMQEAIASFDNQDEVLFLVDLWGGTPFNQANSLLEDHKDKWAIVAGMNLPMVIEAYASRFSMESAQEIATHILETAKDGVKVKPEELQPAEAPKAAATEDAQPKGSLPPGTVVGDGKIKFVLARIDSRLLHGQVATAWTKATQPNRIIVVSDAVAKDDLRKKLIEQAAPPGVKANVIPISKMIEVAKDPRFGNTKALLLFENPEDVLKVVEGGVEIPEVNVGSMAHSVGKVVVSKVLSMGQEDVDTFDELKAKGIKFDVRKVPNDSKANMDEILKKAKNELANA

SEQ ID NO: 172 - protein, 871 aa, Enterococcus faecalis
MKNKSRQFLKNNWPYMLASFFIPFLIMAIIYLSIGIYPGSSRSVLASDAFSQFSNFHASFNNVLHGKQSLFYTWNASLGLNYLSLISYYLGGLFTPLVFFFNNQNMPDALYFLTLLKIGSAGLSFWFLAKQTFKIPKWSHVTLSVSYALMSFIVAHSELIMWLDAFIYLPLVILGIHRLMDQRKPTLLFVSYFLLFITNYYFGFMIGLFSFLYYFARTFTDWQRYKSRIVAYFTTSLLAGGASMIMVLPAVLDLRTNGETLSEITTFKTEATAFLDIIMKNMIGVYDTTKYGSIPFIYIGLLPLIFCLFYFVTKEVPLKNKLLFGSLFVLLIASFYITPLNLFWHGMHAPNMFLFRYSFLFSFLVILLAGYGWEKFEKDDLGVLSGLILILLAIFALAMGTKGATSYTYVTLTSFVLTATFLLLYFFGIAFYQLKKAPMQYLVILLLLLVSGEAIINTRAMVTGILDDWNYASRSLYSEPYPDLKNLVDQTKKENDTFYRLENLNGVSANDGINYGYSGISMFSSVRNRHSSTYLNALGFRSRGTNLNIRYQNNTLLMDALMGIKYNIAENNPMKFGFERQAAAGKYQLYRNENALPLGFLADKEIYNVRQPLNDNLGSQTNLLNALANTNERYFTFYQPTMTLQNNVTITQNTAGVTFTEKQHNVAKEISYTVNVPANTQAYLSLFPTDFAQLESSTATVTVNGSSQQSQIGITGQYYNLGYYPKDTTVNFKVSFYGTKAVSFVQPQVVGLNTNAFEKAISAVQEKGVDLTTGKRSASGTFTADKDQVLVTTIPYDKGWRVKIDGKKVTPKAFKDAFLSVPVSAGTHTIQFSYLPEGLIPGIVLFVLCTGGFVAYVTLIPARRNRKKEDK

SEQ ID NO: 173 - protein, 1313 aa, Enterococcus faecalis
VKKLSFKKVKWGMHFLMAVALIAPSVTSTAYAVETTSQQSSEAVTSTTDSSRKQEPVITQETTDIKQEAPNQATSDSVKQSQETTAPTETTNLETSIAEKEETSTPQKITILGTSDVHGQLWNWSYEDDKELPVGLSQVSTVVNQVRAQNPAGTVLIDNGDNIQGTILTDDLYNKAPLVNEKTHPMITAMNVMKYDAMVLGNHEFNFGLPLIKKIQQEATFPILSANTYNKEDGLRFVEGTTTKELDFNQDGQPDLKVGIIGLTIPHIPLWDGPRVTSLNFLPLKEEAEKAVTELKANDQADIIVASIHAGQQNSDPAASADQVIENVAGIDAYILGHDHLSFTKQGAAPNGKTVPVGGPKDTGTEVVKIDLSVAKNADKWEVQEGTATIVPTTNVPADEAVKAATKEYHEKTRAFIQEEIGTATADFLPKQEIKGIPEAQLQPTAMISLINNVQKEVTGAQLSAAALFKYDSKLPAGKISYATIFDIYKYPNTLVSVPINGENLLKYLEKQGAYYNQTQPDDLTISFNPNIRVYNYDMISGVDYKIDISKPVGERIVDAKIDGQPLDPAKEYTIAMNNYRYGGLASQGIQVGEPIKNSDPETLRGMIVDYIKKKGTLDPEQEIERNWSIIGTNFDEKWRAKAIELVNDGTLQIPTSPDGRTPNAAAITKQDVRNAGFDLDNAYTIMHTNDVHGRLEAGKGELGMARLKTFKDQENPTLMVDAGDVFQGLPISNFSKGADMAKAMNEVGYDAMAVGNHEFDFGLEIALGYKDQLNFPILSSNTYYKDGSGRVFDPYTIVEKSGKKFAIVGVTTPETATKTHPKNVEKVTFKDPIPEVEAVIKEIKEKYADIQAFVVTGHLGVDETTPHIWRGDTLAETLSQTYPELDITVIDGHSHTAVESGKRYGKVIYAQTGNYLNNVGIVTAPESEPTKKTTKLISAAELLELPENPAVKAIVDEARTNFNAENEKVIVDYIPFTLDGQRENVRTRETNLGNLIGDAIMSYGQDAFSQPADFAVTNGGGIRADIKQGPIKVGDVIAVLPFGNSIAQIQVTGAQVKEMFEMSVRSIPQKDENGTILLDDAGQPKLGANGGFLHVSSSIRIHYDSTKPGTRLASDEGNETGQTIVGSRVLGIEIKNRQTQKFEPLDEKKQYRMATNDFLAAGGDGYDMLGGEREEGISLDSVLIEYLKSATSLRLYRAATTIDLAQYKEPFPGERIVSISEEAYKELIGGGETPKPDPKPDPKPTPETPVATNKQNQAGARQSNPSVTEKKKYGGFLPKTGTETETLALYGLLFVGLSSSGWYIYKRRNKAS

SEQ ID NO: 174 - protein, 1305 aa, Enterococcus faecalis
MNQQTEVKKRFKMYKAKKHWIVAPILFLGVLGAVGLATDNVQAAELDTQPGTTTVQPDNPNPQSRNETLKTAVSEEAALQKDTTSQPTTAEEVVPKGIAAEQSSATSNDTTNVQQPTAEAEKSAQEQPVVSPETTIEPLGQPTEVAPAENDANKSTSIPKEFETPDVDKAVDEAKKDPNITVVEKPTEDLGNVSSKDLAAKEKEVDQLQKEQAQKIAQQAAELKAKNEKIAKENAEIAAKNKAEKERYEKEVAEYNKHKNDKGYVNEAISKDLVFDSSIVTKDTKIDKITGGKFIKASDFNKVNQGQSKDIFTKLSKDMNGKATGNFQSSKVAAVEFGPKGGYAVLLEKNKPVNVTYTGLNASYLDRKITKAEFIYELQSAPSQSGTLNAVFSNDPIITAFVGTKNANGKDVKVRLTIKLYDANGKEVLPDKDHAFAYALSSLNSSLGTNYSVEHAEFVSDFGSKNEFKYINGSYVKKQADGKFYSTEDLDYGTGPSGLKNSDWDAVGHKNAYYGSGVGLAREGGRISFSFGMTTKGKVNLSGAQWFAFSTNLNAKSIRPYQKKGNPKEPEKATIEFNRYKANVVPVLVPNKEVTDGQKNINDLNVKRGDSLQYIVTGDTTELAKVDPKTVTKQGIRDTFDAEKVTIDLSKVKVYQADASLNEKDLKAVAAAINSGKAIDVTASYVLNLDQNTVTAMMKTNADGSVVLAMGYKYLLVLPFVVKNVEGDFENTAVQLTNDGETVTNTVINHVPVSNPSKDVKADKNGTVGSVSLHDKDIPLQTKIYYEVKSSERPANYGGITEEWGMNDVLDTTHDRFTGKWHAITNYDLKVGDKTLKAGTDISAYILLENKDNKDLTFTMNQALLAALNEGSNKVGKQAWSVYLEVERIKTGDVENTQTENYNKELVRSNTVVTHTPDDPKPTKAVHNKKGEDINHGKVARGDVLSYEMTWDLKGYDKDFAFDTVDLATGVSFFDDYDETKVTPIKDLLRVKDSKGADITNQFTISWDDAKGTVTISAKDPQAFILAYGGQELRVTLPTKVKANVSGDVYNSAEQNTFGQRIKTNTVVNHIPKVNPKKDVVIKVGDKQSQNGATIKLGEKFFYEFTSSDIPAEYAGVVEEWSISDKLDVKHDKFSGQWSVFANSNFVLADGTKVNKGDDISKLFTMTFEQGVVKITASQAFLDAMNLKENKHVAHSWKAFIGVERIAAGDVYNTIEESFNNEKIKTNTVVTHTPEKPQTPPEKTVIVPPTPKTPQAPVEPLVVEKASVAPELPHTGEKENTLLSVLGAGMLVGLAWFGLKKREVK

SEQ ID NO: 175 - protein, 191 aa, Enterococcus faecalis
MKRIGYARTTIIEDDLKNQLTTLQSFGCDDIFQETFDPQAEISVLDEVEKLLSAGDTLIVCKLHHLGKTTRQLTDFMKMLKEKQVDFVSISEGIDTHLPTGEAYFQLMESLSAMECALIKERTLVGLHKARENGKVGGRPKIDGRTVRKIRALYYENKETIQFISNKCGVSVGTCYKYINLPETDVERLYS

SEQ ID NO: 176 - protein, 496 aa, Enterococcus faecalis
MSKKEINQVVASSYQLYINGEWTTGSGNKMIASYNPSNGEKLAEFVDATNADVDRAVEAAQEAFQTWKDVDVVTRSNLLLKIADLIEENQEHLAMVETLDNGKPLRETQSIDVPASADHFRYFASVIRGEEGSVKEFDKDTLSIVVKEPIGVVGQIIPWNFPLLMGAWKLAPALAAGNTVVIHPSSSTSLSLLELFKIFDQVLPKGVVNLITGRGSDSGNYMLAHPGFDKLAFTGSTEVGYTVAKAAADRLIPATLELGGKSANIIFEDANWERALEGVQLGILFNQGQVCCAGSRVFVQSGIYDQFVEALKEKFEQVNVGFPWEKDVEMGAQINEHQLEEILKYVEIGVKEGATLITGGQRLTENGLDKGAFLAPTLLANGTNAMCVAQEEIFGPVATVIKFETEEEVIRLANDSEYGLGGAVFSQDINVALRVARGVRTGRMWVNTYNQLPAGAPFGGYKKSGIGRETHKSMLDAYTQMKNIYIVTKEEADGLY

SEQ ID NO: 177 - protein, 632 aa, Enterococcus faecalis
MGKYHELAEKIVKNVGGQENINSLTHCITRLRFKLKDESQANDDVLKNMDGVVTVMKSGGQYQVVIGNHVPAVYEEVVSIAGLSGEREEEASSGNLFDRLIDILSGCFQPFLGALAAAGMVKGLNALLVFLKLYTATSGTYTMLNGIGDAIFYFMPVILGYTAAKKFRLHPMVGIVIGAALCYPTIQGSALQTAFETTAGAGAAAPYNLFGLPAYNTFMGIPWVGANYTSSVVPIIFIIAFAAQVQKVFKRIIPEVVQTFLVPFFVLLIALPIGFLVIGPIVSMLTDLLSAGFTALMSFSPALYGLILGFFWQVLVIFGLHWSVVPLAIMQVTQEGSSQVLTGSFAASFAQTAVVLAMFFKLKDKKLKALCPPAIISGIFGVTEPAIYGITLPKKWPFIYSMIGGAVGGLYLMINNVTAYTMGGLGIFGVLNFINGDDASGMIQSFIAIAIAAVVGFGLTFFFWKDNTVEEEEVIIDKTTIKKENITSPVKGRVLSLKNAEDPAFANGALGNGVVIEPTEGKVVAPFDGTIVTLFPTKHALGLISDNGTELLIHIGIDTVQLEGEGFEAFVKQGDRVKKGQTLVTFDLEGIKKAGFSTQIPIVVTNTADYLDILEVGSNEVSTSDDLLTALI

SEQ ID NO: 178 - protein, 828 aa, Enterococcus faecalis
MESKTFDIEGMSCASCAQTIEKATAKLPGMAKASVNLATEKLSVTYDQTEVTEEEIKEAVSDAGYKAISPAQQRTFAIEGMSCASCAQTIEKAVNQLSGVQQAIVNLATEKLVVSYDDHQVTSAEIIKAVTDAGYQATEEVAAGATADQDREKKQKHIAEMWQRFWISAVFTVPLLYIAMGHMVGLPLPDFLNPMTHAMTFAMVQLILTLPVLYVGREFFTVGFKALFKGHPNMFSLVALGTSAAFVYSLYGTVMIFLGDTSFTMALYYESAGVILTLITLGKYFEAVSKGKTSDAIKKLMGLAPKTAHILRDGVEIEVPVDAVQLDDIVIVRPGDKIPVDGVIVSGSSSVDEAMLTGESLPVEKKVGDAVIGASINKNGSFQFKATKVGKETALAQIIQLVEDAQGSKAPIAQLADKISGVFVPIVIGLAVLSGLAWFFLGQESWIFALTITISVLVIACPCALGLATPTAIMVGTGKGAENGVLIKSGDALETTHKIQTIVFDKTGTITEGKPVVTDILVADSALSEAELLTLAASAEQGSEHPLGEAIVGAAKERQLPLAEGSDFSAIPGHGIRVTVNERVLLLGNIKLMKEEAIELSTFVQQADRLAEEGKTPMFVAKDGSFAGIIAVADTVKDSSQTAIARLHKMGIEAVMITGDNKRTAEAIAKQVGIDRVLSEVLPEDKALEVKKLQAEGKKVAMVGDGINDAPALAQADVGIAIGSGTDVAMESADIVLMRSDLMDVPTAVELSKATIKNIKENLFWAFAYNTLGIPVAMGVLHLFGGPLLSPMIAAAAMSFSSVSVLLNALRLKGFKPSTVKRTSGSQK

SEQ ID NO: 179 - protein, 433 aa, Enterococcus faecalis
MKKKILAGALVALFFMPTAMFAAKGDQGVDWAIYQGEQGRFGYAHDKFAIAQIGGYNASGIYEQYTYKTQVASAIAQGKRAHTYIWYDTWGNMDIAKTTMDYFLPRIQTPKNSIVALDFEHGALASVPDGYGGYVSSDAEKAANTETILYGMRRIKQAGYTPMYYSYKPFTLNHVNYQQIIKEFPNSLWIAAYPIDGVSPYPLYAYFPSMDGIGIWQFTSAYIAGGLDGNVDLTGITDSGYTDTNKPETDTPATDAGEEIEKIPNSDVKVGDTVKVKFNVDAWATGEAIPQWVKGNSYKVQEVTGSRVLLEGILSWISKGDIELLPDATVVPDKQPEATHVVQYGETLSSIAYQYGTDYQTLAALNGLANPNLIYPGQVLKVNGSATSNVYTVKYGDNLSSIAAKLGTTYQALAALNGLANPNLIYPGQTLNY

SEQ ID NO: 180 - protein, 370 aa, Enterococcus faecalis
LPMIIKQEQFIPKDTVETTIDLLIRNLTTIKDNTGEFLLDFDGLKVDDKSWTIWNWPQGVGLYGIYKNYRNTKSEKALQVVNDWFEGRMQEGAPPKNVNTMAPLLTMAYLYEDTKDSKYIPYLEQWAEWVMEEMPRTNEGGLQHATYGPENKNQLWDDTLMMTVLPLAKIGKLLNRLDYLEEAKHQFLIHIKYLQDKKSGLWYHGWTFEGNHNYAEALWARGNCWITIAIPEIIEILELPKGDSLREFLLSTLNAQVAALAKYQDESGLWHTLINDSNSYLESSATAGFAYGILKAVHKKYISSEYEEVANKAIAGLLNEIDETGEVQHVSVGTGMGDNLDFYRTIGMTAMPYGQSLTILCLTELLVSYC

SEQ ID NO: 181 - protein, 1301 aa, Enterococcus faecalis
MKAKKQYKTYKAKNHWVTVPILFLSVLGAVGLATDNVQAAELDTQPETTTVQPNNPDLQSEKETPKTAVSEEATVQKDTTSQPTKVEEVAPENKGTEQSSATPNDTTNAQQPTVGAEKSAQEQPVVSPETTNEPLGQPTEVAPAENEVNKSTSIPKEFETPDVDKAVDEVKKDPNITVVEKPAEDLGNVSSKDLAAKEKEVDQLQKEQAKKIAQQAAELKAKNEKIAKENAEIAAKNKAEKERYEKEVAEYNKHKNENSYVNEAISKNLVFDQSVVTKDTKISSIKGGKFIKATDFNKVNAGDSKDIFTKLRKDMGGKVTGNFQNSFVKEANLGSNGGYAVLLEKNKPVTVTYTGLNASYLGRKITKAEFVYELQSSPSQSGTLNAVFSNDPIITAFIGTNRVNGKDVKTRLTIKFFDASGKEVLPDKDSPFAYALSSLNSSLTNKGGHAEFVSDFGANNAFKYINGSYVKKQADGKFYSPEDIDYGTGPSGLKNSDWDAVGHKNAYFGSGVGLANGRISFSFGMTTKGKSNVPVSSAQWFAFSTNLNAQSVKPIFNYGNPKEPEKATIEFNRYKANVVPVLVPNKEVTDGQKNVNDLNVKRGDSLQYIVTGDTTELAKVDPKTVTKQGIRDTFDAEKVTIDLSKVKVYQADASLNEKDSKAVAAAINSGRAKDVTASYDLHLDQNTVTAMMKTNADGSIVLAMGYKYLLVLPFVVKNVEGDFENTAVQLTNDGETVTNTVINHVPGSNPSKDVKADKNGTVGSVSLHDKDIPLQTKIYYEVKSSERPANYGGITKEWGMNDVLDTTHDRFTGKWHAITNYDLKVGDKTLKAGTDISAYILLENKDNKDLTFTMNQALLAALNEGSNKVGKQAWSVYLEVERIKTGDVENTQTENYNKELMRSNTVVTHTPDDPKPTKAVHNKKGEDINHGKVARGDVLSYEMTWDLKGYDKDFAFDTVDLATGVSFFDDYDETKVTPIKDLLRVKDSKGVDITNQFTISWDDAKGTVTISAKDPQAFILAHGGQELRVTLPTKVKADVSGDIYNSAEQNTFGQRIKTNTVVNHIPKVNPKKDVVIKVGDKQSQNGATIKLGEKFFYEFTSSDIPAEYAGVVEEWSISDKLDVKHDKFSGQWSVFANSNFVLADGTKVNKGDDISKLFTMTFEQGVVKITASQAFLDAMNLKENKNVAHSWKAFIGVERIAAGDVYNTIEESFNNETIKTNTVVTHTPEKPQTPPEKTVIVPPTPKTPQAPVEPLVVEKASVEPELPQTGEKQNVLLTVAGSLAAMLGLAGLGFKRRKETK

SEQ ID NO: 182 - protein, 270 aa, Enterococcus faecalis
MKKILFASLFSATLLFGGSEISAFAQEIIPDDTTTPPIEVPTEPSTPEKPTDPTPPIEPPVDPVEPPITPTEPTEPTEPTTPTEPTTPTEPSEPEQPTEPSKPVEPEKPVTPSKPAEPEKTVTPTKPTESEKPVQPAEPSKPIDVVVTPTGELNHAGNGTQQPTVPIETSNLAEITHVPSVTTPITTTDGENIVAVEKGVPLTQTAEGLKPIQSSYKVLPSGNVEVKGKDGKMKVLPYTGEEMNIFLSAVGGILSVVSGFVIFKKRKAKV

SEQ ID NO: 183 - protein, 302 aa, Enterococcus faecalis
MGSRFGLMLKQGGNDVLLIDGWQEHINAIKENGLKANYNGEEITVKVSIVNQNEVPTGEQFDLIILFTKAMQLEKMLQDVKPLIADHTEVLCLLNGIGHEDVIEKFVPMEKIFIGNTMWTAGLEGPGKAKLFGSGSVELQNLGIGQEESAKKLAETLSASGLNAKYSDNIHYSIYRKACVNGTMNGLCTILDVNMAGLGATKPAHDMVVTIVNEFAAVAAKENVNLDIPEVIEHVETCFDPTTIGMHFPSMHQDLIKNNRLTEIDYINGAISRKGKKYGVVTPYCDFLTQLVHSKEEILGAK

SEQ ID NO: 184 - protein, 856 aa, Enterococcus faecalis
MQTTEEMQSGDGRRGRLRIFFGFAAGVGKTYGMLTEAHELLMMGKHVVVGYIEPHDRPDTNRLLEGLPQIPPKNIFYKQMVLTEPDIDQIIQQKPEIVLIDELAHSNAEGSRNRKRYQDIDELLNAGIDVFTTVNVQHIESLNDIVEEVTGIEVKETVPDTFLRQATIRVIDVEPDELIERLEQGKIYANENAKRALKNFFIPQKLDQLRGLAIQRASDHINRISGKTIGIQSKLLTVVNDAFPKMTEKCIRWTARLAQGLVVDWTVIQVRTQENTPTNIPLADKLGAEVISIEEDDSFETIVEFAKMTGVTDIIMGKNLRQPWYEKIFIEAFDDRLLKRLKDTELHLIPFNEEKRSLFFKTRKVIEGGGKDLVIAIGGVFLATVVTELMQYIHVGDQNLMLIYISFVLLVARTTSGYFWSSLSSILSVLSFNWFFVEPLYSLTVYKQGYPFTLLLMLVVALMSSNLMIRLKKQADTSMKKEHQMEILYELNKRYVLVESRKQILDISATYLSRLLEREVIIFDRQVKTESVHCINEKKSILNNEDEAAVAFWAAKNQKEAGNGTDTLNGAKGFYLPIAAGRKTLAVLGIERNADLDLENDQLNYLKLVLTQIAVILEQTELKDEKEQVELENEREKVRSNLLRAVSHDLRTPLTVISGIAETLGIGNDLKEETQRKLLKDIQEESQWLIRMVENLLSITRINMDTMKVNKTAEPVEEVIEAVYKHLRKVYPDGQVDIHLPEEVIFIQADPILIEQALFNLIENAFRHGENDLPVKLNVYQEKEQTVFEIENHGEIPLKQFQKIQSNLSGTNEVPVDSKNGLGIGLSIVKTIVHAHNGKMEMTIGRGKTLVRIYLK

SEQ ID NO: 185 - protein, 580 aa, Enterococcus faecalis
MKNFYKKKFALTDQGAEALTKASISSFFVYCINMVPAFIIMMLIDELVLENAKPRWLYFAVSFVTLLFMYWLLDREYENLYNSTYKESAHLRVQIADDLSNLPLSYFSKHNLSDLSQTIMSDVEGIEHAMSHAIPKSGGMALFFPFISVMLLVGNVKMGLAVILPTLFSFVLILLSKKSQTKANTKYYDTLRENSEEFQETIELQQEINSFNLSKKVQDRLFKKMEESERIHLKVELSTFSVMALSSIFSYVSLAVVILVGVHLLLTGEVTILYVVGYLLAAIKIKDSFDSMKEAVLEIFYLAPKIQRIRAMKETSIQEGSDSPLKSFDVELRDVSFSYDNNTPILDHISFTAKQGEVTALVGASGSGKTSILKLVSRLYDYDEGCILIDGYDIKRVSPASLFSKIAIVFQEVTLFNTSILENIRIGNSQASDEEVKKAARLANCEDFIEKLPDGYHTLVGENGSSLSGGERQRLSIARAFLKNAPILILDEITASLDAENEKRIQESLNRLIQDKTVLIISHRLKSIEKVNKIVVMDQGKVVDQGTHSELYRRSEIYKNLIKKTKLSEKFVYEKEAQSR

SEQ ID NO: 186 - protein, 480 aa, Enterococcus faecalis
LTLSDTLGQREVTALSYDSRDVTAETLFFCKGLNFKEIYLENAVKDGLEIYVSEVPYEVPAQLGIIVTDIKKAMAVLSMAFYDYPQNKLKLIGFTGTKGKTTAAYFTKYILDVATQQKTALLSTMNSTLDGKTFFKSALTTPESLDLYRMMATAVANGMTHFIMEVSSQAYKTNRVYKLFFDVGIFLNITPDHISPIEHPTFDDYFYCKRQLITHSKVIVLNHEADYFPLLKETAQQQKVPAIVYGSQPAPEVDYSFAVSSEDSLRFIVESPADALGLAGSYHLRLGGDFNKGNALSAAIASVLVGASKEECQQGIAATTVPGRMESLTNTNGATVYVDYAHNYDSLKNLLTFVREEHPDGRLIVLVGSTGDKAISRRKDFGRVLSELADVAVLTTDDPASEDPAKICQEIQAHITKEMPVYTVLDRGEAIAHALSLSTTADDAIVLAGKGADLYQKVNGVDEPYAGDFALAEAFINKKN

SEQ ID NO: 187 - protein, 359 aa, Enterococcus faecalis
MFLGFNEMKYSKGRYVLVVLVMVLIAWLIFILSGLANGLAQGNRLAVDQWQANQVVLSKEANSNLNVSVLDENVKETISGGKIAPIGQQSLAIRPADDKKAELTNVSLFGIEKESFLMPKVIEGNAFTDKNQVIASETLKNQGFKIGDKLTAGKYDEQLEIVGFISKSSYNIVPVIYTSLDTWRSIKYGDNPAMAKMVNGFIVRSKDNTEVKTTNKDSQVLSISDFIEKLPGYSAQNLTLDGMIYFLIVIAAFIIGIFIFVMTLQKTAMFGVLKVQGVPTSFLAKAVMLQTALLAVLGVAIGLALTGITVLFLPEAMPYATNGPRMILFSVLLILSALIGGAFSIRTIAKIDPLIAIGG

SEQ ID NO: 188 - protein, 322 aa, Enterococcus faecalis
MQIFPYSDDPNKRYHTWNYALRQQFGEKIFKVPIDGGFDCPNRDGTVAKGGCTFCSVSGSGDMIVAPSDPLPLQFQKEIQLMHQKWPTVDQYIVYFQNFTNTHAPVDVIRHRFEQVVNEKGVVGLSIGTRPDCLPDEVVNYLAELNERFYLWVELGLQTTFEETSAAINRAHDYQTYLDGVAKLRKHGIRVCTHLINGLPGETPAMMRENVRRTIQDSDIQGIKLHLLHLMTNTKMMRDYNEGRLQLMSKEAYVSVICDQLEMIPPEIVIHRLTGDAPFETIIGPMWSLKKWEVLNAIDAEMKRRNSYQGKYTVISGKEVFN

SEQ ID NO: 189 - protein, 737 aa, Enterococcus faecalis
MKKESMSRIERRKAQQRKKTPVQWKKSTTLFSSALIVSSVGTPVALLPVTAEATEEQPTNAEVAQAPTTETGLVETPTTETTPGTTEQPTTDSSTTTESTTESSKETPTTPSTEQPTADSTTPVESGTTDSSVAEITPVAPSATESEAAPAVTPDDEVKVPEARVASAQTFSALSPTQSPSEFIAELARCAQPIAQANDLYASVMMAQAIVESGWGASTLSKAPNYNLFGIKGSYNGQSVYMDTWEYLNGKWLVKKEPFRKYPSYMESFQDNAHVLKTTSFQAGVYYYAGAWKSNTSSYRDATAWLTGRYATDPSYNAKLNNVITAYNLTQYDTPSSGGNTGGGTVNPGTGGSNNQSGTNTYYTVKSGDTLNKIAAQYGVSVANLRSWNGISGDLIFVGQKLIVKKGASGNTGGSGSGGSNNNQSGTNTYYTVKSGDTLNKIAAQYGVSVANLRSWNGISGDLIFVGQKLIVKKGASGNTGGSNNGGSNNNQSGTNTYYTIKSGDTLNKIAAQYGVSVANLRSWNGISGDLIFAGQKIIVKKGTSGNTGGSSNGGSNNNQSGTNTYYTIKSGDTLNKISAQFGVSVANLQAWNNISGSLIFAGQKIIVKKGANSGSTNTNKPTNNGGGATTSYTIKSGDTLNKISAQFGVSVANLRSWNGIKGDLIFAGQTIIVKKGASAGGNASSTNSASGKRHTVKSGDSLWGLSMQYGISIQKIKQLNGLSGDTIYIGQTLKVG

SEQ ID NO: 190 - protein, 231 aa, Enterococcus faecalis
MMIVVLLMSSCLFLFVSYQLYLRLLVEKLDSEDRTLKRKINFYKYQKNSRLMIYLLFSVCLLSVLLLGIVYTYYQLNQRNIRMEQRIERLAQGQATQGDKIKKQAIKKTALNQFPWKQAVSAESAAVLTNYELQLAREWRPYLGETSITMIRSEKTQTLTLSVFSVGLSYHEFQTGQDNIVALIAALNSVKEITMIDFNFTYRDQEQTLVKSIDTYARETLETNLEPVVIS

SEQ ID NO: 191 - protein, 154 aa, Enterococcus faecalis
MSNYTIIDLNQQPHLIPSAAQWFSQKWQIPAEAYQASMQEMLTSENHVPHWWVCLNKQQDIVAGVGVIDNDFHNRADLTPNLCALYVEPTFRHQGLAGILLTTVGDFLANSGFKKLYLLTDHTTFYERYDWEFLTMVTTEEQSCARIYQKQLRQ

SEQ ID NO: 192 - protein, 342 aa, Enterococcus faecalis
MKNSENDYIQSLFQILPGLLTAFLVACLSKFLAIWLPSLGAATIAILLGIFLGNTFVRGANLNRGTKVAESKLLEFSVVLLGTTVTFQTIAQIGLQGVAFILIQMSLTIIFAYLIGKKLAFSDNMSLLMAGGNAVCGSSAIASIAPAIQADEEEKGQIITLVNLLGTVLMLTLPILSGILYGTNLLARSALIGGTLQSVGQVVASANMVNENAVQLAMLFKIMRIVLLVAVVYLFGRFKQSKTAESEAELVEVTKKSSALPWYVVGFFIACVFNSLIHFPVVISETAHFFSSWFEITALAAIGLRLDFKKFFQEGKRFLIYGLSVGTVQVVLAILLLALLQF

SEQ ID NO: 193 - protein, 440 aa, Enterococcus faecalis
MAKTGMYVGLDIGTTSVKVVVAEYIEGQMNIIGVGNAKSDGLNRGIVVDIDQTVQAIQRAVRQAEEKAGIQIKSVNVGLPANLLEVESCQGMIAVSSESKEITDEDVRNVASAALVRSTPPERQIVAILPQDFTVDGFEGIKDPRGMLGVRMEMFGVVYTGPKTIIHNIRKCVEKAGLGINELVITPLALTETILTDGEKDFGTIVIDMGGGQTTTSVIHDKQLKFTHVNQEGGEFITKDISIVLNTSFNNAEALKINYGDAYPERTSANEEFPVDVIGKSEPVRVDERYLSEIIEARVEQILRKSKEVLDEIDAFELPGGVVLTGGAASMPGIVDLAQEIFEANVKLYVPNHMGLRNPVFANVISIVEYSAQLNDIYHIAKYAIPGEKSKPAQSVAVQQEVRYDTYAEQPQEEYEEFNERESGEKVTGKIKDFFSNIFD

SEQ ID NO: 194 - protein, 105 aa, Enterococcus faecalis
MAKKTIMLVCSAGMSTSLLVTKMQKAAEDRGMEADIFAVSASEADTNLENKEVNVLLLGPQVRFMKGQFEQKLQPKGIPLDVINMADYGMMNGEKVLDQAISLMG

SEQ ID NO: 195 - protein, 270 aa, Enterococcus faecalis
MKKEIIVYTISDSLGETSQKLLAAASAQYPDISFLNRYNFSFVTTEEELLEILKDALKDKALVVSTLVSKQLITAAKEFSERTGLLYLDLMAPFFELIQAKAGVDPIEEPGRRHQLDRAYFDKISAIEFAVKYDDGKNPQGFLDSDILLLGVSRTSKTPVSMYLANQGYRVSNLPLIPEVPLPPILEEMDPQKMIGLVCSPETLGQIRSSRLASLGLGNETSYTNVERIEQELAYAEEIFAKYGIPVIDVTAKSVEETAFLIKEKLDERN

SEQ ID NO: 196 - protein, 745 aa, Enterococcus faecalis
MEWIEIKHATQNNLKNISVNIPKKQLTVVTGLSGSGKSSLVFDTLAAESRRELNDTFSSFVQNYLPKYGRPEVEKIENLPVAIVIDQKKVAGNSRSTVGTYTDIYTFLRLLFSRAGSPFVGYSDTFSFNHPDGKCPTCDGLGKITEINLHQLVDYDKSLNKGPIDFPTFTVGNWRWKRYAHSGLFDLDKKIKDYSPEELALFLYAPQQKLANPPKEWPHTALYEGIVPRMQRSILHTDEGKRHQKYLNHFVTVKRCPDCLGSRVNERVRSCKINQKSIADAVDMPLTELHSFIRSMDLSLIKTIQEELLVRLEALINIGLSYLTLGRATETLSGGEAQRIKIAKYVNSALNDIMYILDEPSAGLHPKDIERISRALLNLKNKGNTVVLVEHNPQLIREADFIIDIGPFAGENGGHVQFSGTYDAFLVSKTLTSQALQEPLPLNDQPRKARKSLSIEHATLHNLNNLSVEVPLGVLTVICGVAGSGKSSLAEEIYQKAQADNQEIIHLSQKSITANLRSTPMTYLNIFDKVRKLFAEENHVSPALFSYNSKGACPTCKGKGIIVSDMSFMEDVTSICETCHGTRYKEEVLHYLYNGKNIVEVLALSVKDGYDFFKDQPFALSLKNLLEVGLSYLKLNQSLSTLSGGELQRVKLADTLHQKKAIYLMDEPTDGLHLIDIQQSLQLFNRMVEEGNSLILLEHHIDVIKSADWLIELGPEGGKNGGQLLFTGTPANMLNSTHSITKGYL

SEQ ID NO: 197 - protein, 553 aa, Enterococcus faecalis
MKKLKMLGCVGLLLALTACQAGTGNSADSNKAAEQKIAISSEAAISTMEPHTAGDTTSTLVMNQVYEGLYVLGKEDELELGVAAEEPAISEDETVYTFKIREDAKWSNDDPVTANDFVYAWQQVASPKSGSIHQALFFDVIKNAKEIALEGADVNTLGVKALDDKTLEITLERPTPYLKSLLSFPVLFPQNEKYIKEQGDKYATDAEHLIYNGPFKLKEWDNASSDDWTYEKNDTYWDAEKVKLTEAKVSVIKSPTTAVNLFDSNELDVVNKLSGEFIPGYVDNPAFLSIPQFVTYFLKMNSVRDGKENPALANNNIRKALAQAFDKESFVKEVLQDQSTATDQVIPPGQTIAPDGTDFTKLAAKKNNYLTYDTAKAKEFWEKGKKEIGLDKIKLEFLTDDTDSAKKAAEFFQFQLEENLDGLEVNVTQVPFTIRVDRDQTRDYDLELSGWGTDYRDPLTVMRIFTSDSTLGGVTFKSDTYDQLIQETRTTHAADQEARLNDFAQAQDILVNQETVLAPIYNRSISVLANQKIKDLYWHSFGPTYSLKWAYVN

SEQ ID NO: 198 - protein, 625 aa, Enterococcus faecalis
MKQLKKVWYTVSTLLLILPLFTSVLGTTTAFAEENGESAQLVIHKKKMTDLPDPLIQNSGKEMSEFDKYQGLADVTFSIYNVTNEFYEQRAAGASVDAAKQAVQSLTPGKPVAQGTTDANGNVTVQLPKKQNGKDAVYTIKEEPKEGVVAATNMVVAFPVYEMIKQTDGSYKYGTEELAVVHIYPKNVVANDGSLKKVGTAENEGLNGAEFVISKSEGSPGTVKYIQGVKDGLYTWTTDKEQAKRFITGKSYEIGENDFTEAENGTGELTVKNLEVGSYILEEVKAPNNAELIENQTKTPFTIEANNQTPVEKTVKNDTSKVDKTTPSLDGKDVAIGEKIKYQISVNIPLGIADKEGDANKYVKFNLVDKHDAALTFDNVTSGEYAYALYDGDTVIAPENYQVTEQANGFTVAVNPAYIPTLTPGGTLKFVYFMHLNEKADPTKGFKNEANVDNGHTDDQTPPTVEVVTGGKRFIKVDGDVTATQALAGASFVVRDQNSDTANYLKIDETTKAATWVKTKAEATTFTTTADGLVDITGLKYGTYYLEETVAPDDYVLLTNRIEFVVNEQSYGTTENLVSPEKVPNKHKGTLPSTGGKGIYVYLGSGAVLLLIAGVYFARRRKENA

SEQ ID NO: 199 - protein, 148 aa, Enterococcus faecalis
MKTPTFGKREETLTYQTRYAAYIIVSKPENNTMVLVQAPNGAYFLPGGEIEGTETKEEAIHREVLEELGISVEIGCYLGEADEYFYSNHRQTAYYNPGYFYVANTWRQLSEPLERTNTLHWVAPEEAVRLLKRGSHRWAVEKWLAAAS

SEQ ID NO: 200 - protein, 152 aa, Enterococcus faecalis
MARVESFELDHNTVKAPYVRLAGTEQNGDALVEKYDLRFLQPNKDALPTGALHTLEHLLAVNMRDELKGIIDISPMGCRTGFYMIMWDQHSPQEIRDALVNVLNKVINTEVVPAVSAKECGNYKDHSLFAAKEYAKIVLDQGISLDPFERIL

SEQ ID NO: 201 - protein, 160 aa, Enterococcus faecalis
MNIFAVRLKEALTAKNIKPSDLAKKTGIGKSSISDWLAGRYEAKQDKVYRIADALDINEAWLMGQEVPMEKNASTIDRIYKKLEPQRQAIVYQFAEQQLHEQQTQAEILSFPRRDEMTLAAHAGDPEKIFSKEEIEKIHDYLDEIDAKYQQSISSDKKED

SEQ ID NO: 202 - protein, 308 aa, Enterococcus faecalis
MYKFVDTNQATHSTPLPSEALNFNGQFLEKVIPGYQTLSVSGRELVPSEIESYQLGIRDGKRHVYARIPERELTVKYRLSAVNNEAFRDAFNHLNVALFTEKDVSIWFNDEPEMLWFGSKSSVSDVPEGVNQVTGTFTLLLSDPYKYTRSDATSVMWGSPTITFQANYLMGNTGSGAFDFPILIEGGAYWGSTMITFQNRAYTMGDLGKEVRPIEIYPTVEGLKVKPTIILTGTGRGVWIKTRNDTINLGDFDRSEIIIDTENFYLTKNGAPMIRPMNDFYLYPNEPLYIQAKDSDFRLTIRYPNRFV

SEQ ID NO: 203 - protein, 274 aa, Enterococcus faecalis
MDFFSSEEIVASLGDKAEMKGKLSFVRLCILGIMAGFCIALGYLAFIRITGTAPTEWGSFNNFLGGALFPVGLIALTFVGGELATGNMMVMTLGVLQKKVRVGALCYNWIVVLLTNCLGGFLVAYLFGHIVGLTEGAFLDKTVAVAQAKIADPPLVAFVSGIGCNIFVCLAVYLGALAKSYLGKMFGLWFPVMVFVVCGFQHVVANAFIIPAAIFSQSTTISWWDYLQNTLWVFLGNAVGGSLFMAVPLIFMTKPATVKPRVEKTIQTEELYGN

SEQ ID NO: 204 - protein, 788 aa, Enterococcus faecalis
MNQRILSTLGFDKVKQQLLQFIVTAQGTNEVSELLPIADENKIQSWLNETQDGLKVQRLRGGIPIPKLENIQPHMKRIEIGADLNGIELAQVGRVLSTTSELTRFFDELSENEVDFERLYMWREQLEVLPELNRQLKQAIDDDGYVTDEASPALKAIRQNIRRSEQTIREELDSIIRGKNARYLSDALVTMRNERYVIPVKQEYKNIFGGVVHDQSASGQTLFIEPKQILEMNNRLRQQQIAERNEITRILAELSAELVPYRREITHNAYVIGKLDFINAKARLGKELKAVVPEISQANHVVFKQARHPLLNPEKAVANDIVIGEEYQAIVITGPNTGGKTITLKTLGLLQLMGQAGLPIPVEEESKMGIFTEVFADIGDEQSIEQSLSTFSSHMTNIVSVLKKVDHQSLVLFDELGAGTDPQEGAALAIAILDSLGAKGAYVMATTHYPELKVYGYNRAGTINASMEFDVDTLSPTYRLLIGVPGRSNAFEISKRLGLDNSIIEAAKQIMDGESQDLNEMIEDLENRRKMAETEYLEARHYVDESAALHKELKEAYQVFFEEREKELQKARKEANKIIAEAEENAETIISDIRKMQLESGQQGGVKEHQLIDAKTQLSQLHHEETKLAKNKVLKKAKEQKKLKAGDEVIVNTYGQRGTLLKDNGKGQWQVQLGILKMNVSEEDMTPVAPQKEAKPRVTTVRSAESSHVGTQLDLRGKRYEEALAEVDQYIDAAILAGYPQVTIVHGKGTGALRTGITEFLKNHRSVKSYEFAPQNQGGNGATVVKFQ

SEQ ID NO: 205 - protein, 288 aa, Enterococcus faecalis
MKEITGATRLAGLFAKPSQHSISPLIHNTAFQNLGVDARYLAFDVGQETLPQAIEAIRTFHMLGANLSMPNKVAAVSYMDELSPTAQLVGAINTIVNKDGKLYGDSTDGTGFMWSLKEKKVDVFQNKMTILGTGGAALSIIAQAALDGVKEIAVYNRKSAGFNDSQKKLANFTERTNCVIHLNDLADTEKLAKDVAESVLLVNATSVGMHPHAHSSPIENYAMIQPKLFVYDAIYNPRETQLLKEARLRGAETSNGLDMLLYQGAAAFEQWTGQKMPVSVVKRKIENR

SEQ ID NO: 206 - protein, 310 aa, Enterococcus faecalis
MTKGYVKSVTELIGQSPVVKLKRMVPEGAADVFVKLEFFNPGGSVKDRIALSMIQQAEADGRLKPGQTIIEPTSGNTGIGLAMVGAALGYPVKIVMPDTMSIERRKLMQAYGADLLLTPGAEGMKGAIAKATALAEEHGYFMPLQFNNPANPMVHEQKTGKEIVDVFGKRGLDAFVSGVGTGGTVTGVGHELKRIFPDIEIVAVEPTESPVLEGGEPGPHKIQGIGAGFVPEVLDTTVYQKVAAVSSEDALETARLMGPKEGILVGISAGAAIKAAIDLAVELGAGKRVLALVPDNGERYLSTALYEFPE

SEQ ID NO: 207 - protein, 478 aa, Enterococcus faecalis
VKNQHLTTSQGSPVGDNQNSLTAGEFGPVLIQDVHLLEKLAHFNRERVPERVVHAKGAGAHGIFKVSQSMAQYTKADFLSEVGKETPLFARFSTVAGELGSSDTLRDPRGFALKFYTDEGNYDLVGNNTPIFFIRDAIKFPDFIHSQKRNPRTHLKSPEAVWDFWSHSPESLHQVTILMSDRGIPLSFRHMHGFGSHTFKWVNAAGEVFFVKYHFKTNQGIKNLESQLAEEIAGKNPDFHIEDLHNAIENQEFPSWTLSVQIIPYADALTMKETLFDVTKTVSQKEYPLIEVGTMTLNRNPENYFAEVEQVTFSPGNFVPGIEASPDKLLQGRLFAYGDAHRHRVGANSHQLPINQAKAPVNNYQKDGNMRFNNGNSEINYEPNSYTETPKEDPTAKISSFEVEGNVGNYSYNQDHFTQANALYNLLPSEEKENLINNIAASLGQVKNQEIIARQIDLFTRVNPEYGARVAQAIKQQA

SEQ ID NO: 208 - protein, 642 aa, Enterococcus faecalis
MAENYQQAAKDIIQLIGMDNIISVTHCQTRLRFILKDHEQVDGKQLEKIDLVKGVFYNGGQYQVILGTGIVTKVYDEIEKLGINVVSKAEQTAILKNNETGMRKTMRILSEIFIPIVPVIAATGLFLGLKGVIFNDTFLQLFGASVANIPESFQQIVSVITDTVFAFLPALIVWSTFKAFNATPVIGIVIGLMMVSPILPNAYAVATPDSGVKAIMAFGFIPVVGAQGSVLSAIAAGIIGAKIELFFRKKMPNILDQIFTPFMTMLITFLIMILGIGPILHTVELGMVDVVQWLIGLPLGLGGFVIGASYPLMVLIGIHHTLTMVETSLLANTGFNALITICAMYGFANVGSCLAFAKKAQDSKVKSTAIGSMLSQLFGVSEPVLFGLLIRWNLKPLLCVLFTSGLGGAILAIFHIQSNSYGLAVIPSFLMYIYSAHQLVIYLLVALLSVGVCYALTSLFAIPQEVLISDKVIEEEEREVFEMQHNTLDEQLFSPVTGYAMNLTAVNDPVFSSEMMGKGLAIMPTANKVYAPADGLLNLVAETGHAYGIQTDAGAEVLIHIGIDTVTLGQEVFQTQVTQGHRVKKGDLLGTFDRKAIKEAGLDSTVMVIITNTSSYLSVEPMMSDHNEITPEQIILNLNTPN

SEQ ID NO: 209 - protein, 492 aa, Enterococcus faecalis
VELVDKDLRSIQETRNLIRKAKEAQQVLATFSQKQIDAIVQAVSEATFNQREKLAKMANEETGFGIYEDKIIKNAFASKVVYDEMKDKATVGVIHDDAAKKVTEIAVPVGVIAGLIPSTNPTSTVIYKALISLKAANSIVFSPHPNALKSIIETVEIIQKAAIAAGAPEGCVSVIKTPTMQATSELMKNKETNLILATGGNAMVKAAYSSGTPAIGVGPGNGPAYIERSANVPHAVKQIMDSKTFDNGTICASEQSIIVETVNREAVKEELIKQGAYFLSPAEADKLAKFILRPNGTMNPQIVGRSVQHIASLVGLSIPKDRRLIVAEETHVGLKYPFSREKLAPIIAFYTVENWEAACALSIEILKGEGAGHTMGIHTENKEVIREFGLRKPVSRLLVNTSGTLGGIGASTNLVPALTLGCGAVGGSSTSDNIGVENLFNLRRVAYGVRDLEEIRQEFGQTSTTSVATSCETTNQEELVNAVVAQVLARLN

SEQ ID NO: 210 - protein, 467 aa, Enterococcus faecalis
MNELNKTPKEIVKELDQYIVGQQAAKKSVAVALRNRYRRLQLEENMQQDITPKNLLMIGPTGVGKTEIARRLAKIVNAPFVKVEATKFTEVGYVGRDVESMVRDLVENAIQIVEKQQYSRVYAQALKKANQRLVKVLVPGIKKEQKQAGGNQFEQMMNMFNMAQQQQEAQEEVTEDIRTNRRTILEQLEKGLLDNREVTIEIEEPKKTMPAMNNGLEQMGIDLNETLGALSPKKKIERTVTVKEAQELLVKEESAKIVNDADIHSEAIRLAESSGIIFIDEIDKITSKSQQNSGEVSREGVQRDILPIVEGSQVNTKYGPLQTDHILFIASGAFHLSKPSDLIPELQGRFPIRVELDDLTADDFVSILTEPNNALIKQYVALIGTENVSVIFTKEAIERLAHIAYDVNRDTDNIGARRLHTILERLLEDLLYEAPDMQMGEITITEAYVNEKLNDIVQNEDLSRYIL

SEQ ID NO: 211 - protein, 188 aa, Enterococcus faecalis
MAKRIIIMNFDIESKSYQAFSEIKKMQAERQLKGEQMAVVTHVNDGQHQFKINDFIDFTGNNHTSKDSMIGMLVGILGGPLGILFGWFAGSMYGASKDAKEIQEAQTVFEHVIQKIDEGQTGLLLIAEEEDNRPLNQLVMFDLGGEITRLDLEEVQQEINDANEVANEAKQSWQAKKEQHKEATSKEE

SEQ ID NO: 212 - protein, 333 aa, Enterococcus faecalis
MEKQTITIYDVAREANVSMATVSRVVNGNPNVKPATRKKVLEVIDRLDYRPNAVARGLASKKTTTVGVIIPDVSNAFFASLARGIDDVATMYKYNIILANSDGDDQKEVTVLNNLLAKQVDGIIFMGHRITDDIRGEFSRSKTPVVLAGSIDPDEQVGSVNIDYTEATKDATATLAKNGNKKIAFVSGALIDPINGQNRMKGYKEALAENGLSYNEGLVFESEYKFKAGINLAERVRNSGATAAFVTDDELAIGLLDGMLDAGVKVPEEFEIITSNNSLLTEVSRPRLSSITQPLYDIGAVSMRLLTKLMNKEEIEEKTVVLPYGIDQKGSTK

SEQ ID NO: 213 - protein, 384 aa, Enterococcus faecalis
LKKYNVDWNYWVVRFLFVMALIVGYLLITNYQHFVHSVSGLLGILSPFITGFVIAYLLSGSQKKIEGLLERVPLPVVKKAKHGLSVLLLYLIILFIFVLTLNYIVPLLISNLVDLANSLPTFYDHMVQFVMSLEDKGILKTAAIEKYLNSVLKDLSPERFLNQWTQALFSLGTLTKNVSSFFLNAFLTLIISIYALVFKQSILTFVEKAAHKLLSEKVYKQTQTWLNTTNKIFYKFISCQFLDACIIGVSSTILLSILNVKFAVTLGILLGICNMIPYFGSIFASIVAGVITLFTGGVTQAITVLLVLLILQQIDGNIIGPRIMGDALNVNPILIIVSITIGGAYFGVLGMFLAVPVAAIIKIIVSEWLNESKENDKIVDSIES

SEQ ID NO: 214 - protein, 284 aa, Enterococcus faecalis
MKKFSIRKISAGFLFLILVTLIAGFSLSANAEEYIVPAESHSRQKRSLLDPEDRRQEVADTTEAPFASIGRIISPASKPGYISLGTGFVVGTNTIVTNNHVAESFKNAKVLNPNAKDDAWFYPGRDGSATPFGKFKVIDVAFSPNADIAVVTVGKQNDRPDGPELGEILTPFVLKKFESSDTHVTISGYPGEKNHTQWSHENDLFTSNFTDLENPLLFYDIDTTGGQSGSPIYNDQVEVVGVHSNGGIKQTGNHGQRLNEVNYNFIVNRVNEEENKRLSAVPAA

SEQ ID NO: 215 - protein, 652 aa, Enterococcus faecalis
MKRKKIKNQLLVLTSILVLLSLEVAPVVTLAAELPSSSLQTALSSETTITSEEKVTETTETTVATSTTSTSSSSSESSSSTDTTTESTSQSTTETTTTNTSSETKKEPTEPTVSSEITQPVEQSQPPQVPVTKQEPEEPIQVPEANNNFVEENQAVSLNPSLKVDEIASSNLKGYELPLLSSFGEKKRAVVVAEALRHVGKTKKEFNLTEQALTSSFLAQKIYQQLFKIDIGSTPQEQMTFGKVRSIEEAEPGDLIFWQTAEGKTLQNGVYLGQGKYLIAAAESDSKEKPEVIAQLENIYTAKQQPDSKEEKRLVVTNPFKEFILTEYGKEVLATYGASFEMQKSEQTTAFIKKIGETARELGEKYDVFASVMIAQAILESGSGESQLAKEPYYNLFGVKGSFQGNSVSFSTKEADQRGQLYTISAGFRDYGGYNDSLQDYVQLLRQGIDGNQDFYKPAWRSEAKNYLQATRFLTGKYATDKQYDNKLNSLIAVYNLTQFDLPKTVDGLIIQSKNKLSEAEQQQMHFPVYDGINYNRSGSYPVGQCTWYVYNRFKQLGTSVDEFMGNGSDWGRKGRALGYQVSSLPKAGRAISFQPGVAGADNQYGHVAFVEAVTSDGIIISESNVINDQTISYRVLPNVIAYSSGVTYIGA

SEQ ID NO: 216 - protein, 187 aa, Enterococcus faecalis
VDAEAYLGPDDEAAHSFGLRKTPRLQAMYDKPGTIYLYTMHTHLILNMVTQEQGKPQGVMIRAIEPVEGVDKMIENRQGRQGVELTNGPGKLVAALGIDKQLYGQSIFSSSLRLVPEKRKFPKKIEALPRIGIPNKGRWTELPLRYVVAGNPYISKQKRTAVDQIDFGWKDEENEKSNNAHILRGTT

SEQ ID NO: 217 - protein, 282 aa, Enterococcus faecalis
MAKKKNVSVISVEKPTWFPLTDETGAFPVYGAPITIGTAVSIKPDVTTETTPDYGDSVVQDQYVAFGGAEVTLETNGYQNEVLAEITGGKKLKGGVLRSADDIASDGAFAYRRRKSNGKYRYTIFYKGKFALTSDETSTLEGSSVSYTHPEWTGSFVDVPGLGYMYSVDEDDEGVDLEMIKNWFTEVMDPRKENTTAVTGVTLDQTELNLKVGQTATLTPTITPDNASNKKYQFRSESEAIGTVTPIQGKVTAVGEGTTEIVVTTEDGNFTAKCTLNVTTAD

SEQ ID NO: 218 - protein, 777 aa, Enterococcus faecalis
MFLGLIFILFGVFGLFRLGFLGTLLANCLRLVVGNTFPFAAILLILYGLLVMIYGKDFPLKRGRPIFGAVLIYISVLLFFHAFMFRNVSGSQPDILGNTWEFLQSDLKANQVTQNVGGGMIGALLYQGTYFLVAQFGSYLIATLLLLAGIFLMSMWDFQQIVDHFQSIQDRLSHVSAKSQARQEEKEAKRAAKKEAKAAERQAKIEAAAQQKLQERERMEQAAAERLTKTPVETHQPMVEEPAAPTPVQIDSFQQQNQAMPVPPIAATKPQREQEEEAADEAGVLEFEISEEAEDRDYQLPPTDLLDTIQATDQSGEYEKIEKNIGVLEQTFKSFGVDAKVVKASLGPSVTKFEVQPAVGVKVSKIVNLTDDIALALAAKDVRMEAPIPGKSLIGIEVPNSAISTVSFRDIVEAQPSHPDKLLEVPLGRDISGMVQTADLSKMPHLLIAGSTGSGKSVAINGIITGILMQAKPHEVKLMMIDPKMVELNVYNGIPHLLTPVVTNPRKAAQALQKVVQEMEFRYEKFAATGVRNITGYNQLIQQKNAEDGENRPILPFIVVIVDELADLMMVASNEVEDAIIRLAQMARAAGIHMILATQRPSVDVITGIIKANVPSRMAFAVSSGTDSRTIIDTNGAEKLLGRGDMLFLPMGENKPIRIQGAFISDQEVERVVAFVTDQQEAEYQESMMPTDEPTTSGGGEAPQDELFEEAKNLVVEMQTASISLLQRRFRIGYNRAARLVDELEAHGVIGPSEGSKPRKVFLQAESEEAATETPEQ

SEQ ID NO: 219 - protein, 249 aa, Enterococcus faecalis
MRKSFNLAVQALTVQYQGRTALNNIHVTIPSGKITGIIGPNGAGKSTFIKGLLGLIKTKERDVLLNNQAIDQQKTTIAYVEQRSALDLSFPISVFETVLLGTYPNLGLLKRPGKKEKQAAMAALKMVQLEDYAQRQIGELSGGQLQRVFIARVLAQGAEVIFLDEPFVGIDMSSEKVIMDILKSLKNQGKMIIIVHHDLHKVSHYFDELIVLKNRLIAAGPVEQTFTAETLQEAYGDLLGDLLIQGVAK

SEQ ID NO: 220 - protein, 177 aa, Enterococcus faecalis
MIGLELTFTVPQADEVIRSLVETYHDEKDIVIGAGTVLDAVTARLAIMAGAEFIVSPSFNRETAEICNLYQVPYLPGCMTITEMQTALKSGVDIVKLFPGSTYGPSIISAFQAPLPYLNIMPTGGVSLDNMASWFEAGVTAVGVGGNLLAHAKTGEFGKVTALAKQYMAKFREIKEN

SEQ ID NO: 221 - protein, 316 aa, Enterococcus faecalis
LAGVTKEQIAKAKEWDLLSYLQAYEPQELKKSGPREYCTRTHDSLKISNGKWCWNSRGIGGRTALDYLIKVRGMDFVGAVETLCGYCAPPPEKAPPIKEKQPKPFRLPQASRCASAVVGYLQDRGIDPELLGVCMEAGILYESCKYQNCVFVGRDTAGNARAASLRGTRDGFRMDVEGSDKRYSFCLPAGKADCPRLAVAESPIDALSLATLVKLSGGEPRDSHYLSLGGTGPRALIQFLHDHPHVTQVSLCLDNDKAGLEGMERLTQEIQNDAELSRRVKLVYPNPPKQGKDYNEFLCTHVKAVRTAQRQRDAAR

SEQ ID NO: 222 - protein, 112 aa, Enterococcus faecalis
VRIKEGRTVGLFTKVSPEEKAAIDRKMELLGTSNLRAYLRKMAVDGYIVQLDMGAVLELVKLLRSVSSNVNQIARRCNSTHNLYEQDVEDLRQGYSEIWQGVNDLLKKFEAL

SEQ ID NO: 223 - protein, 3173 aa, Enterococcus faecalis
MANKLQTVSQLADQTAKAVTRNAEGWKSYLTTASRLYKYSFDEQLLIYAQRPDATACASMELWNEDMRRWVKAGSKGIALIKKDGIRPRLTYVFDVADTRPVRGAKMPYLWEMKDGHHAAVMDTLARRYGETEKKDIGSALMEQAKHAVEEVYREHLSDLAYDAQDSLLEGLDDFNLEVRFRNLLTASVQYTLLSRCGLNPADYLEDEDFDGIHEFSTPAVLHHLGSAASEVSMNMLLEVKKAIRQAEKEKAQNRQKIPKNPEKPLAKEPVIGYTKVKEQFNTLKRESEERSIQNGRTGIQEDGRLPDSRLGDGRGGRDGGNAAGQVRQAAADLSSGTPQGDIHLDAADRAAGTPPAGDRPAGAGTGRPDRGGIKETERRGRGDESPRPDGMGAGSQPVSRPGGGNRTERDRLQVNQENQQEAAGEQSAVSASEKPAFTQFSLFPTVEQQIETIAQAQKTEQELRPAVSSGKVTDAVIGRALTSGGNEPDSILRIVAFFQKDPTEQSAADFLQKEYGSGGKGLKIAGHEYSLWFSHSGIHIAPGRSAGGGSLVTWKQAAAQIRQLLNSGQFASQDKIDAARDNEFRELSEKLWFLRQNFSEEAKEKGLLPTIDALYGGFPDSTAKIAALLKDPAERAKIAQEVRQFAISHQENPNLLRFRQRPAPSELFTRLTDMDKPVTAFHGVEGFAPARGAFVTEDEITRMFTGGSGVSEGKFRIYAYFMQGHDAKECIEFLKNEYGIGGHGYIGYDEWHDGKGIKLSRADDFSGGNYDTVTLNWKQVQKRIAGLIKTDRYLNRREKAYLPEYEKMQLARSLYTFQYYDPNDASKTIPHDWDVDAAKKVFRPLLDDPEQCAAHYEKMVKALAMVSPDERAYSLMEPTLQKMGAYLRGEYSLFTPLPDAVLQEERQKKQKQKQKERQDSARQTAEPATGLAAAAKALSRKKQPAPREDADGQLTLDMFGLSSEPEQPAATPEPEPELSQAETGASETAVPIASKPEPPQETPNIPEGAAPIMAESPADRYDLGYGHMGNGLTVWNRLEEEHGDYKTVAHIAPDRTVTFYDADMPEEIREKIQKVAAATEMSISATQDTPVFSTPPQEPERVQPGNSEPEPEKVQDAPAAVNPEPETGDSNIVPSPAQKAGAEPTGTGSPQTQEAPKTAAADGLNLTPNVEEYLNLKAQYPDKLVGVRVGKTMLFYGTDAEEAAPALGTKTITRDIPDLGMVSITGANGWQSVLKKLLEHGKSVVLARPDTERGGDAPYEIIKERSAADYIPVGMELTIDGRLMKIDSVDYNAGTVSLQDMELRGWYPIFRSESIPFVRQFVEEVQQEHFTAEPMQEPERPETSDLDTAKQLIEQFAYAEYGSDDVDFSDLEHIGIAYGTTEDGGLEVQVDVNLLDFSISQSVDGKCVETRQYGSLRELIDMELAFLDYDMLVSVEPDIEERLKAELNQRIRWSEMAGAREGVEPTEPEIFPEKDVSPEQEAPPELVEIDGGQITETPAQRQTRRRAQEEVDSRVFPSEIILQPLRLEPERHNFRITDENLGAGGEKTKYQYNVEAIRTLKQIEAENRLATPEEQAILSRYVGWGGISHAFEPNDPKWAKEYAELKELLTPGEYQSAQSTVLNAHYTSPTVIQAIYNAVEQMDFTPGTVLEPSMGIGNFFGMLPEKLAAAKLYGVELDDLTGRIARQLYQKADITVDGFERTDHPDDFFDLAVGNVPFGSYQVHDKRYDRQNLMIHDYFITKTLDKVRPGGIVAFITTKGTMDKKNSKAREALAQKADLLGAVRLPSNAFKANAGTEVTTDILFFQKRDRIPEKLPEWVEVGQTEDGIPLNRYFLDHPEMVLGTMTMGRSMYGNETETACQPIPGADLSGQLAEAIRHIAPPDRELLEVDSGQDGEELESIPADPTVRNFSYTLSNDKLYFRENSRMTQAVLGKTPTERVRGMIGIRDSARRLIDLQLAGADDTEIQSEQAKLNRLYDAFSAKYGLLNSTGNKLAFEQDSSYPLLCSLEIINEEGKLERKADMFTRRTIQTHRAVTSVDTAVEALAVSIGEKACVDLGYMASLMGGPEKIPQIVEDLKGIIFKNPATGPFDLEDGGAHWHQGWQTADEYLSGNVRAKLAIARAAAEENPQFAINAEKLEQVQPKDLTASEISVRIGASWIDPEYYQQFMFELLHTPVYLQDRKIKLQYSPTTGEWNVQGKSTDNRDNVRVYATYGTKRINAYEIFEQTLNQRDVRIFDKTEVDGKEVRVLNEKQTAIAQQKQEAMCETFKDWIFKDPERRETLCRRYNEKFNCIRPREYDGSHIRFAGMNPEISLRTHQENAVARMLYGKNSLLAHCVGAGKTFEMIAAAMEGKRLGLNQKSLFVVPNHLTEQWGGDFLRLYPGAKVLVATKRDFEPARRKKFCARIATGDYDAIIIGHSQFEKIPLSPERQKAVIKGQIDEIVTAIAEAKAEDGERYTIKQMEKTKKNLEAKLQKLADGKKKDSVVTFEELGVDRLFVDEAHGFKNLFLHTKMRNVAGIAQTDAQKSSDMFAKCRYMDEITGGRGIVFATGTPVSNSMVELYTMMRYLQFDTLEQNGHRHFDAWAADFGEKVTAMELKPEGSGFRSKTRFAKFYNLPELISIWKEAADIQTADMLNLPVPKAEYITVTTEPSGFQKEMVEELGERAESVRGGQVDPHIDNMLRITSDGRKLALDQRLQNPLLPDDPDSKVNACVKNIVQEWQASTEILGTQLVFCDLSTPKGDGSFNVYDDIKEKLIAKGIPEAEIAFIHDANTETQKAELFAKVRRGQVRVLIGSTAKMGAGTNVQNRIVASHDLDCPWRPADLEQRAGRSLRQGNMNASVKMFKYVTKGTFDAYNWGLVENKQKFIGQIMTSKSPARSAEDVDATALSYAEVKALATGDDRIREKMDLDVQVSKLKMLKANHTSQQYEMQDKALKYYPQKIAETKLLIEALTADLPTVQAHPVKDDAFSMTVMGQTYTERKAAGEAVIKACMLMDDPEKTVDLGEFRGFPMQLRCDGSKFRVTMKQNLTYSAELSDDAVGNVTRINNALESLTERLDAQKARLATLESELENAKEEADRPFPKEEELREKSARLNQLNRELSRPDKKEDEQEVEESPDLEDAGKPAPVVPMPAVAAGYKPSIRQAIRNYEPPTPVHSGMERTPRKEAVL

SEQ ID NO: 224 - protein, 628 aa, Enterococcus faecalis
MPVLTSGQQERKSKQRKIRNSEYYDMEGTFDRLYAESKKDKTFNHLMEIIESEENIKLAYRTIKKNTGSDTSGVDKRTIADLAKLSEEEYVRLIRKQFSNYHPGPVRRVEIPKPNGKTRPLGIPTIVDRIVQQCILQVMEPICEAKFSENSNGFRPNRSAETAIAQCMRLIQVQHLYHVVDLDIKGFFDNISHTKLIRQIWALGIRDKKLLCIIKEMLKAPVVLPNGEKTYPARGTPQGGILSPLLANIVLNELDWWIASQWEEMPTKTKFKTRSNAQGTEIKSHAYRALRRSRLKEMHAVRYADDFKIFCATHEDAVRAYKATELWLKDRLGLEISPDKSKVVNLKRQYSDFLGFKLKVRKKGKKYVVRSHMSDKAYKKAHEKVSEEVKKLAYSSDDNAQFMQLQKYNSVVAGLHEYYCISTEVSHDFSRLAFSINKQLRNRLKGDLSKKGQLRNGFIKEKYGASRQMRFLHGRPVVPLGYVQSKNAQHKRKSINKYTVKGREQIHKNLAIDTATMLWLMRNPVKGRTIEYADNRISLYAAQYGKCAVTGIPMNSHDIHCHHKVPVSNGGSDEYANLILVSKAVHILIHASSEPTIEKYLKSLNLDNKQIEKLNKLRSMAEMPPIIL

SEQ ID NO: 225 - protein, 1451 aa, Enterococcus faecalis
VTEKARDLFDKLMTQIQLDDTAKEHPLIQNGRIDKVIVHQQSRLWEFHLSFDELMPVMLYQTFMQQLELAFQQIAQVSVQITTNQTTFTEEQLTDYWQLALLNSQCNTPLVQKVLKTQTPQFEDRKIILPVDNEAVIPYLKQQYLPIIEELYFSYGFPKFHIEPKMDQQQAAEVLKKFEEQKLEQAAAFQQQAAESLVKHEQMKKEKQQQAPAFDGPIRLGRNIPNDEPIMPMGNILEEERRITIEGFIFDKEVRELRSKRKILILKITDYTSSFVVKKFSNGEKDEQVFDAIQPQSWIRVRGSVQEDTFMRDLVMNAQDLMEVAHAPRKDYAPEGEKRVELHMHSNMSTMDATNKVGDLVAQAGKWGHKAIAITDHGGAQAFPDAHAAGKKAGVKILYGVEANIVDDGVPIAYNEEHIELTDATYVVFDVETTGLSAVYDTIIELAAVKMHKGNVIETFEQFIDPGHPLSQTTINLTGITDEMVRGSKSEEEVLRMFKEFSEGTILVAHNASFDMGFLNTSYGKHGIPEAANPVIDTLELSRFLYPHFKSHRLNTLSKKFGVNLEQHHRAIYDSESTGHLCWIFLKEAKENHDMHFHDDLNRHIGEGDSYKRARPFHATILATTQAGLKNLFKLISMSNVDYFFRVPRIPRSQLSKLREGLLIGSACSNGEIFEAMMQKGVEEAKNRAKFYDYIEVMPKPVYAPLIEQELVKNEADLEEIISNLVKIGDELGKLVVATGNVHYLNEEDAIYRKILVGSMGGANPLNRHSLPKVHFRTTDEMLTEFQFLGQDIAKRIVVENPNKVADLCEEVIPVKDDLYTPKIPGSEQEITDLSYNRARELYGDPLPEIVEKRLEKELNSINGNGFSVIYLISQKLVHKSNEDGYLVGSRGSVGSSFVATMTGITEVNPLAPHYYCPECQYSEFYEDGSYGSGFDMPEKACPKCGARLFKDGHDIPFETFLGFHGDKVPDIDLNFSGDYQAEAHNYTKVLFGEEYVYRAGTIGTVADKTAYGFVKGYERDHNLHLRGAEIDRLAKGSTGVKRTTGQHPGGIIVIPDYMDVYDFTPIQYPADDQEAEWKTTHFDFHSIHDNILKLDILGHDDPTVIRMLQDLSGIEPKTIPTDDPEVMRIFEGPDVLGVDAEQIYSKTGTLGIPEFGTRFVRGMLEQTHPSTFAELLQISGLSHGTDVWLGNAEELIRRGEANLAEVIGCRDDIMVYLIHAGLDSGMAFKIMETVRKGQWNKIPDELRDTYLNAMKENNVPDWYIDSCSKIKYMFPKAHAAAYVLMALRVAYFKVYFPILYYCAFFSVRADDFDLVAMSQGKEAVKARMKEITDKGMDASTKEKNLLTVLELCNEMLERGYKFGMIDLYKSDAENFVIEGDTLIAPFRAVPSLGLNVAKAIVAAREEQPFLSKEDLATRGKVSKTLIEYMNENGVLKDLPDENQLSLFDML

SEQ ID NO: 226 - protein, 680 aa, Enterococcus faecalis
MERSNRNKKSSKKPLILGVSALVLIAAAGGGYYAYSQWQAKQELAEAKKTATTFLNVLSKQEFDKLPSVVQEASLKKNGYDTKSVVEKYQAIYSGIQAEGVKASDVQVKKAKDNQYTFTYKLSMSTPLGEMKDLSYQSSIAKKGDTYQIAWKPSLIFPDMSGNDKISIQVDNAKRGEIVDRNGSGLAINKVFDEVGVVPGKLGSGAEKTANIKAFSDKFGVSVDEINQKLSQGWVQADSFVPITVASEPVTELPTGAATKDTESRYYPLGEAAAQLIGYTGTITAEDIEKNPELSSTGVIGKTGLERAFDKELRGQDGGSLVILDDKENVKKALQTKEKKDGQTIKLTIDSGVQQQAFAIFDKRPGSAVITDPQKGDLLATVSSPSYDPNKMANGISQKEYDAYNNNKDLPFTARFATGYAPGSTFKTITGAIGLDAGTLKPDEELEINGLKWQKDKSWGGYFATRVKEASPVNLRTALVNSDNIYFAQQTLRMGEDKFRAGLNKFIFGEELDLPIAMTPAQISNEDKFNSEILLADTGYGQGQLLISPIQQATMYSVFQNNGTLVYPKLVLDKETKKKDNVISANAANTIATDLLGSVEDPSGYVYNMYNPNFSLAAKTGTAEIKDKQDTDGKENSFLLTLDRSNNKFLTMIMVENSGENGSATDISKPLIDYLEATIK

SEQ ID NO: 227 - protein, 505 aa, Enterococcus faecalis
MKKVLMGVLSLGLLLGAATGCTSDQEKAAGKTKASSEKTEATSGASANGYTDPSELKDSYDVVIVGSGGAGMTAALQAKEAGMNPVILEKMPVAGGNTIKSSSGMNASQTKFQEKEGIKDSNDKFFEETLKGGKGTNDQELLRYFVDHSAEAIDWLDTKGITLSNLTITGGMSEKRTHRPADGSAIGGYLVDGLVRNVREEKIPLFVDADVTDLVEENGQIDGVKVKMKDDKEKTVKAKAVVVTTGGFGANEKLITQYKPELKNYVTTNQEGTTGDGIQMIQKVGGALVDMKEIQIHPTVQQSDAFLIGEAVRGEGAILASQKGERFVNELDTRDKVSAAINALPEKSAYLVFDQGVRDRAKAIDFYDQKGFVEKGETIEELAEKIGMPADTLKATIDTWNQDVNAKDDKQFGRTTGMEADLSTAPYYAIKIAPGIHHTMGGVKINTKTEVLREDGTPIKGLYAAGELTGGLHGQNRIGGNAIADIIIYGRQAGTQSAEFASAQK

SEQ ID NO: 228 - protein, 264 aa, Enterococcus faecalis
VIVRGGGDLATGVIQKLWHVGFKILVLETECPLAIRRTVSVCDAIFQKEQRVEDLVAVRITSLKDCAKCWQQNKLPVFVDQTASAIQQLKPLIVIDAILAKKNLGTHRGMAPITIALGPGFSAPQDVDVVIETMRGHRLGRLYFEGTALPNTGIPGEIGGKSAERVVHAPASGQVTHLKNIGDLVLKGEALFLIDQVPVYSPLTGTLRGLISEKVTCYQGLKCADVDPRPVEKVDCLTISDKARALGGAVLEAIFMIGRRKNVL

SEQ ID NO: 229 - protein, 857 aa, Enterococcus faecalis
MYSIIVNGQSETCETNKKLMDFLREDLGLTGTKDGCNQGSCGACTVLVNGKASKACLFTLEKLAGKEVTTIEGLSQRQKDVYAYAFAKTGAVQCGYCIPGMVISAQGLLNKKPEPTKEDIQKAIRGNICRCTGYVKIIEAIQLAAKMFCEEASIPEEHSNGKLGEDFQRVDAVEKTLGTGIYVDDIDIEGMLHASALRSAYPRAKVLSIDSTQALAHPDCVAVFTAKDVPGNNKIGHLEFISDWDVMIPEGEITRYVGDAVALVVSKRKETLPEIKNLVEVDYEEMIPLTSCEAALAEGAPAIHEKGNILSHEHLVRGNAEEVLENSAFVVTEHYSVPINEHAFMEPECAIAQPEGEGILLFSAGQSIYDEQREVARMLGLDKEKIHVQSKLVGGGFGGKEDMSVQHHASLAAWLLKKPVKVLLSREESLMVHPKRHGMEMDFTTGCDEEGNLTAMKAVIYADTGAYASLGGPVLQRACTHAAGPYKYQTIDVEGFAVYTNNPPAGAFRGFGVCQTAFAIESNLNLLAEKVGLSPWEIRFKNAVAPGDTLPNGQLVSKNAALKEALLAVKDVYEQAEVAGISSFFKNSGVGVGLPDTGRCIISVEEGKIHVRTSAACIGQGMATVTTQIACETLNLPPEMIVAEAPDTRRTPNSGTTTASRQSLFTGEATRRAAMQLRYELDMGRALSDLEGEEFYGEYSAKTDPLINDKKSPVSHAGYGYAAEVAILDDKGKVAKFVAAYDMGQVVNPRAAEGQIEGGIAMGMGYALTEKFALEEGYVKAKYATLGLVNATQVPPIETILVHADNLHEGLAYGIKGVGELATIPTAPALAGAYFALDGQLRPSLPLENTPYQKKKR

SEQ ID NO: 230 - protein, 1001 aa, Enterococcus faecalis
MSDIMHPISIEALLNWIFSEYQQDGTIFGIRKFYHADPTKTISLFGEKMETPCGPAAGPHTQLAQNIIAAYLTGSRFFEVKTVQILDGEDLPVSKPCIAAADECYNVEWSTELRVPQAYDEYVKAWFVLKLLSKEFELGDPNGFIFNMSVGYDLAGIQSPKIDRYINEMQNAEGTPIWAECQAAAKKYLSYFKKVDDLYIEAISPKVCHSITLSTLHGCPSDEIERIAAYLLSEKGLHSFIKCNPTMLGYEYARQTMDELGFDYMVFDDHHFKEDLQFEEAVPMLQRLQLLANSKNLSFGVKITNTFPVTIAANELPGDEMYMSGRSLFPLSISLAQKLSEAFDGKLQISYSGGADIFNSKEIFDAGIWPITMATTLLKPGGYQRMNQVANVLSAAEYPQMVHVNLDKLAQVVEKAKTQARYQKSIKLPESTKLRKTVPLTDCYIAPCRSDGGCPINQDIPAYLRYVSEGNYLKALQVIVDKNPLPFITGTICAHPCMTKCTRQFYEESIHIREVKLEAAEHAYDELLTTLEKPQPKENAPKTAVVGGGPAGISAGYLLAREGMPVTVFEKSETIGGVCSQIVPEFRISMESVQKDVQLAEFMGAEFRTGQEAPSLAELKNQGYTNVIYAIGAWKHGVLRLESGRALNSLEFLKANRENPTINPYGEQIVVVGGGNTAMDCARAATTLPGVKKVSVVYRRNKRNMPADEEELYLALEDGVDFLELLSPIKHENQQLTCEKMVLGERDASGRRRPIGTGEMIDIPADTVIAAVGEKVDTEFYQALGIHTDNYGKVVSNQETLETNIPGVYVIGDANLGPATIVEAIADATKAANNICLVHNHHYEKDNLNSDVAFVRNKRGILVTDEMSCSQASRCLECSTICESCMDVCPNRANIVVYVEGKPQIVHVDRMCNECGNCETFCPYASAPYKDKFTLFNSEADFYDSTNSGFYVQNPVDKICLLRLWGTVSTIQLTDQGLDVPEDLIALMVTMIEEYAYCMQA

SEQ ID NO: 231 - protein, 789 aa, Enterococcus faecalis
MTKQTIKEQILHFMESQKKKSFSMEEIAQGLNLEKSSDFKILVQTIAQMEREKSVSFNKKGKVLLPMKDLLIEGTFRANERGFGFVTIDPEEPDVYIPKEATNFAMDGDTVLIDVIQHADPFSDRGAEGKVKEIKERAVSQVVGEFVAYSEEEMAEMGLYGYMIPKDKKLNQYTVSIAPEGIKPVDGSIVIAEITYYPDQEYPTSMEGLVKQVIGHKNDPGMDILSIVVAHGIPTAFPDEVLAEADQVPETIAESDLVGRRDLRDQLIVTIDGEDAKDLDDAVTVQKLANGNFFLGVHIADVSYYVTEGSQLDMEAYERGTSVYLTDRVVPMIPQRLSNGICSLNPHVPRLTMSCEMEITPEGEVISHEIFQSVIQTTERMTYTAVNEILEEQKPETLERYKELVPMFKEMGELHHILEEMRMRRGAISFEDREAKVLVDENGHPKDILLRTRGVGERLIESFMLAANETVARHYHDLKLPFIYRIHEQPKEEKMQRFFDFAAVLGILVKGTKENISPKDLQKVLEQVENKPEEVVINTMLLRSMQQAKYSEDNYGHYGLAAEYYTHFTSPIRRYPDLIVHRLIRSYSQDQSEKNQEKWNEALPEIANHSSSMERRAVDAEREVDAMKKAEFMVDKVGETYDGIISSVTKFGIFVELPNTIEGLIHVNNLKQDYFHFIENHMALVGERTGMTLKIGQKVQIRVEKADPETREVDFELISAEEVAPVEGPKGRKKGKANSSTRSNNQRRNKKDESFDGKKKKNKKKGKGKKQPFYKEAMKQKNKKGKKKK

SEQ ID NO: 232 - protein, 341 aa, Enterococcus faecalis
MKNRYFILMILSFYFFAFGIETSAAELRFSVETEIPENQIDKTKTYFDLMMKPDQEQILKVRAANSTDENLVIDVSVKSATTNSNGVIEYGESLTALDKSAPADLSEIIQLKDGGESVELPAKSEKAVELRVKMPKEEFSGQLAGGITFSEKVDETKDKQKENTNGLAIENRYAYTVAVLLRENETVVQPELSLEKVEPTQRNARSVISATLLNHEAAYLQSMKVTANVKNKKTNNVILEKEQEDMQMAPNSIFNFPIPYEENEMEAGTYVLAMTVEGSGKKWQFTKEFTISKEEAKTFNEKDVTVKKTESKLIYLLIGLLILLLIICLFIILRLKKQKNK

SEQ ID NO: 233 - protein, 374 aa, Enterococcus faecalis
MSRKRKISLISLVIILVFVTVGSAYFAVAGSYLKKTIDKGYVPIKNDYNEAQNKDSQSFLIMGLDNTIERKLGTTRTDAMMVITVNNKTKKITYLSLPRDSFVQIDAKNYQGMQRIEAAYTYDGPTASVNTVEKLLNIPINHYVVFNFLSFIKLIDAVGGIDVNVKQAFDGVTKDGPGSIHFDAGKQHLDGTKALSYARERHSDNDIMRGFRQQEIIQAVEDKLKSGQSIMKIMDIIDSLNGNIQTDVDSNELTHLVKEGLTWTNYDKQQLSFDWRTFSNEGRSMVELYPDSIENVRHQLRVSLNLEKPDERDQDGYVFHTNGEFLYQSDYTVQDEAAEENEMTSINGNTYIGVPGNTQTGPLPSVKTENGFIK

SEQ ID NO: 234 - protein, 367 aa, Enterococcus faecalis
MKKSQAVQLIQELSNANGVSGFETEVVRILQHATADFTIQRLDSIKNLYLEKKNNLSEGPVVLFDAHSDEVGFMIQAIKENGLLRFFPLGGWVPNTISAQKVRIRNREGTYLPGVVTSRPPHFMTPEERQRPLTIADLTIDIGATSKEEVIETYKIDLGAPVIPDVTCCYNEQTDLFLGKAFDCRIGCACLVDVMEELKEETLPFKLVATVTAQEEVGERGALIAAKQVNPDLAIVFEGCPADDTAETPEMIQSAMGKGPMLRYFDVSMITNPEFQEYALEIAKIHKIPVQVSVRSGGGTNGMAITQVQGAPTIVVGIPVRYAHTPHCYVDFQDYQAAKELVIQLIKNLDADKIQALVQPLSKEWNK

SEQ ID NO: 235 - protein, 404 aa, Enterococcus faecalis
MTTSQMIADFTTLAIQAGGWMELDRLYLQNRLLSMIGEQELGEVDIRPVATPAADLAEQLCQVASANQLVKTEQQKEQFMVQLMDLLTPPPSVVNAFFAQHYAKEPQEATEYFYQLCQKNGTVIEQEEPVVFSTVYGDFLANKVHSEASKATLSAQSYPRCEWCMATEGYQGSQQFPATTNHRVIRMNLDGESWGFSFVKQAQYQQQGVIAFEKHQSAKRSIKTFQQLLKIVEVFPHYFAGIDADFEQNEHVYYQTGLQQFPLAEASISEYVELANYPLINAGMVNWPVETFRLEGPNASEVAQAANDIFEQWQMLKLPTDEIQIVARRKELLYVMDLIFSRPQAKPSLTLAEVQGLTTWNNQKTQALETVASAYQQRLKEASAFAETSEGKAAFLAMVAPVTH

SEQ ID NO: 236 - protein, 132 aa, Enterococcus faecalis
MSILWVINGILLVIVLAMVFNELYLKIMVKRSAKMLTEEEFKETMRKAQVIDVREKDTFDAGHILGARSMPYSMLKTTIGSLRKDQPVYLYDQKKALSIRAANLLRKNGYTDIYILKGGYDGWTGKVKKRNS

SEQ ID NO: 237 - protein, 237 aa, Enterococcus faecalis
VIFMNPDEPNFIWKDLNAVRDMGCIIENELSEVLPNKRYETYSIIGRSGEFNETFNDYEPFDYEIEDVTIPYENLAAVKRWLTGKSKLITHNDEDKYLDAICTMSKPTSFKNEWGVFYTFNVEFRCQPFKRKVNEQPKVIKTKSIEITDHGDEIAFPYIEINSKGGDITLNIGSNSLTILRTQSGIVTIDTEKGKAIQEGNPLFTRGSWIKTNPGQNKLNISGNFIEAKFWNRSAYL

SEQ ID NO: 238 - protein, 645 aa, Enterococcus faecalis
MSIHITFPDGAVKPFDSGITTFDVAKSISNSLAKKALAGKFNGVLIDLDRPIVEDGSLEIVTPDHEDALGILRHSSAHLMANALRRLFPNIKFGVGPAIDSGFYYDTDNGESPVTAEDLPAIEAEMMKIVKENNPIVRKEISRAEALELFADDPYKVELITDLPEDEIITVYDQGDFVDLCRGVHVPSTGRIQVFKLLSVAGAYWRGNSDNHMMQRIYGTAFFDKKDLKEFIKMREEAKERDHRKLGKELDLFMVSQEVGSGLPFWLPKGATIRRTIERYIVDKEISLGYQHVYTPIMADVELYKTSGHWDHYHEDMFPPMDMGDGEMLVLRPMNCPHHMMVYKNDIHSYRELPIRIAELGMMHRYEKSGALSGLQRVREMTLNDGHTFVRPDQIKDEFKRTLELMVAVYADFNITDYRFRLSYRDPNNTDKYFDDDAMWEKAQAMLKAAMDELELDYFEAEGEAAFYGPKLDVQVKTALGMEETLSTIQLDFLLPERFDLTYVGEDGENTHRPVVIHRGIVSTMERFVAYLTEVYKGAFPTWLAPIQATIIPVSVEAHSEYAYEIKERLQAQGLRVEVDDRNEKMGYKIRASQTQKVPYQLVVGDKEMEDATVNVRRYGSKETSVEDLSIFIDSMAAEVHNYSR

SEQ ID NO: 239 - protein, 120 aa, Enterococcus faecalis
VSNKKVAGTIILNLNDGSKKFLMHPIGEAIEFAMAKVSDEMTGLASMLQWFKEEVQLDVTSISLVELTNAHINKENVPLFVFEMDEQALKNEMDKDYTWVAPAELKTIWSKYHIEGVPMF

SEQ ID NO: 240 - protein, 218 aa, Enterococcus faecalis
MKKFDGVIFDMDGLLFDTELIYYTSTQKVADAMGLPYSKEVYLDYVGISDEEVQENYRRIYASYGHDTVEEFIRRSYDDTLQEFRSGNVPLKPGVVEFLDFLDDQKIPRLVASSNVRPAIEMLLSHAGIQDRFVGIVSAEDVKRAKPDPEIFQKARQLLGTEAPKTLIFEDSFHGVSAAHSAGIPVIMVPDLLQPTEVIQEKTLHVLESLHQAPHYLK

SEQ ID NO: 241 - protein, 221 aa, Enterococcus faecalis
MNELVFLHSQYIEEEPYTTDEVIAKYSQIKRESVSKLIKKYQKDLEEFGKVGFEIRAMESGQKAKFYQLNEEQATLLITYLDNTEPVRRFKKALVRQFYDMKNGLYARRMERQKEKSVRKSMTDVIKELGLSPHYYKHYTDLVYKTALGFNAKQLREAREVSKKSTILDFLTSEEIEAVNKREQQVATLLTLKMDYDTIKSILNGQGVLYQTTLKMPVATN

SEQ ID NO: 242 - protein, 283 aa, Enterococcus faecalis
MPKPGETIHAIEHFTAGGGKGANQAVAAKRSGAETYFIGAVGNDGAGAMMTDLMSQDEINLTGVTTLEKTATGQAFIMVDNAGENSIMIYAGANNAFTPKQVQEHQEIIEKSDFVIAQFESAIDSTIAAFKIAKKAGVKTILNPAPALEQVPEELLNVTDMIVPNETETEILTGIKITDEASMRKAAEALHQLGIEAVIITVGSKGAFYDVNGRSGIVPAFKVKAVDTTAAGDTFIGALSSILEKDFSNLEEAIRYGNKASSLTVQRFGAQPSIPYQHELADK

SEQ ID NO: 243 - protein, 224 aa, Enterococcus faecalis
MIKLAHIHKYYYSEEETLHVLDDINLQVDAGEFLAIMGPSGSGKSTLINLLGFIDKKFEGTYLFEDREIGDFSDKELSRIRNEAVGFVFQNFSLIETLTVEENIELPLLYSGLTPKEAKDRVHEVLTKVGLPDKGKKHPKQLSGGQQQRVAIARAIVNRPSFIIADEPTGALDSKTSEEILTLFQQLNNEGVTIILVTHDEETIEYCNRLIKVRDGKILEEVLT

SEQ ID NO: 244 - protein, 388 aa, Enterococcus faecalis
MKKSGQKKRNKKVWFGIGAAVVVVGFIGAKTVFSSKEVEPEYTTYTITEMASLKLDGQVSFLDTRDIFFDPSLGKIAEINVENGKEVKKDSPLLTYNNSDIQATETEQANAVNRNNLQVQQAQENVNLATQKYNEALNKVAAAKQKLNTAKEAEEKETLNAEIQQLNEAVSAANSEVAQANQALQLANSDAVGAANTLEQTRGKVNTVVTAPIDGQVTVDASAMSSTDKPVIKIATQKKNIQGKVTEYDYDKLQTGEEVTVTTVGSGKSAPGKIVSIAQTPIAKNEGNPVVSYQFTVEGDFPWAEGLSTSIAVPQKQMIIPTAAIQKEGQKEFVYVYKAGKAKKTPIETETNLGRKVVKSGLNWKDQVIANPNKELKDNQDVQVAAND

SEQ ID NO: 245 - protein, 1372 aa, Enterococcus faecalis
MIKKIIVVVAFMLTGFSLTAMSASAEEITDLFLQKEVTYSGVEGGKIGENWKYPQFVGEKAVDGDETTRWSADKQDEQWLIVDLGEVKNIGELVLQLHAESPVYEILVSTDGESYQSIFKEENGKGGQPTKKYIDGNNVQARFVKYQQMKMWQHTNKQFYSSSIISFEAYEKKRLPEAIKLLTENLTISEKRKQQLAFEVSPAGVDITEDQIEWSSSDPTIVTVDQTGNLTAVKSGEAKVTVKIKGTEISDTIPVTVVAENKQYAEMRAKWKMRLLGTTQYDNDADVQQYRAQIATESLALWQTLNQAADREYLWERKPSDTVSADYTTQFTNIKKLALGYYEPSSELFEKPEVYDAIVKGIEFMIDTKKYNGTYYTGNWWDWQIGSAQPLTDTLILLHDDLLNTDAEKLNKFTAPLMLYAKDPNIQWPIYRATGANLTDISITVLGTGLLLEDNQRLVQVQEAVPSVLKSVSSGDGLYPDGSLIQHGYFPYNGSYGNELLKGFGRIQTILQGSDWEMNDPNISNLFNVVDKGYLQLMVNGKMPSMVSGRSISRAPETNPFTTEFESGKETIANLTLIAKFAPENLRNDIYTSIQTWLQQSGSYYHFFKKPRDFEALIDLKNVVNSASPAQATPMQSLNVYGSMDRVLQKNNEYAVGISMYSQRVGNYEFGNTENKKGWHTADGMLYLYNQDFAQFDEGYWATIDPYRLPGTTVDTRELANGAYTGKRSPQSWVGGSNNGQVASIGMFLDKSNEGMNLVAKKSWFLLDGQIINLGSGITGTTDASIETILDNRMIHPQEVKLNQGSDKDNSWISLSAANPLNNIGYVFPNSMNTLDVQIEERSGRYGDINEYFVNDKTYTNTFAKISKNYGKTVENGTYEYLTVVGKTNEEIAALSKNKGYTVLENTANLQAIEAGNYVMMNTWNNDQEIAGLYAYDPMSVISEKIDNGVYRLTLANPLQNNASVSIEFDKGILEVVAADPEISVDQNIITLNSAGLNGSSRSIIVKTTPEVTKEALEKLIQEQKEHQEKDYTASSWKVYSEALKQAQTVADQTTATQAEVDQAETELRSAVKQLVKVPTKEVDKTNLLKIIKENEKHQEKDYTASSWKVYSEALKQAQTVADQTTATQAEVDQAEAKLRSAVKQLVKVPTKEVDKTNLLKIIKENEKHQEKDYTASSWKVYSEALKQAQTVADQTTATQAEVDQAETELRSAVKQLVKVPTKEVDKTNLLKIIKENEKHQEKDYTASSWKVYSEALKQAQTVADQTTATQAEVDQAEAKLRSAVKRLTLKNSGENKKEQKNGGNNGHLNTSTGVDQTGTKQVKPSSQGGFRKASQFLPSTGEKKSIALVIIGLLVIASGCLLVFRKSKSKK

SEQ ID NO: 246 - protein, 551 aa, Enterococcus faecalis
MKKSVLFTSLLVLSSLALAACGGGSDDKGASNGGSDNQVYTMVESQEMPSADPSLATDEVSFTTLNNVYEGIYRLDKDNKPAPAGAAEKATVSEDGLVYKVKLREESKWSDGKPVTAADYVYGWQRTVDPATASEYAYMFEPVKNAEKISKGELPKEELGIKAINDHELEITLETATPYFDDLLAFPSFLPQRQDIVERFGKDYTKSSDKAVYNGPFTLTEFDGPGTDTKWSLTKNEEYWDKETVKLDKVAINVVKEAPTALNLYETGEVDDTYLSGELAQQMQNSPDLVQLKAASSFYLEMNQADEKSPLTNANLRRAMSYAIDRDSLAKNILANGSLPSQGFVPVDVAKSPKTGEDFVKEAGSDKLVKYDKKKAVEYWNKAKQELGVSNLTVDLMVDDSEGAKKMGEYLQGSLSDTLEGLKVTVTPVPMAVRLDRTLKGDFQIAVRGWSADYSDPINFLDLLESSTSNNRGRYSNPEYDKFIAASKTTDVNDPEKRWEDLINAEKTVIADMGVVPIYQKAESHLRAPNVKEIIYHPTGAKYDFKWAYKE

SEQ ID NO: 247 - protein, 255 aa, Enterococcus faecalis
MSKKPSGYQKKVLTVLLVSFGFGGLLAQFSPMKSGGFSSWFDDSYVKASAESSKTKEPAPVKIEKKVKPLSYGQQVNQEIEKKQYDGHLDLPLELQTDAKWKDTAYGFGNVDKPNTIEINGCAIVSLAMVGSYMDHQEVTPLDVLAWAKNDFFMEGQGTAWSIFSAYAEMKGYNCQEIGDIETVAAFLKEGHPVIISVKPGYFTTTGHIMVMSGVDEKGDFWINDPNDSEEKGHSKRTFTAEEVMNEALNFWAFY

SEQ ID NO: 248 - protein, 482 aa, Enterococcus faecalis
LKKSVLSALMVCSITLTSVALPSAAFADEYDTKIQQQDQKINALTSQMSDAEAKVAAIENDMVETAKQIDTLTAKKNKLSSEVSKLYSEISDLNVRIQKREVQMTKQARDVQVNGQSDSIIDAVLDADSVADAIGRVQAVSTMMSANNELLEQQKEDKATVEKKTKNVEKQIAELEAATKELNDKTESLKTLKIQQEVAKNDLEAQRSEEQGKKDGFIKQKKEAEKRLAEEQARQRAAAKKAEEQAAAQAQAAAQKAAAEQAKATKAANEAAASAAEEKAATPVVESSTTTESTTTQETTTSSTETESVVTTPVAAAPEKEKEVPVTNPTTPEKGNEAKPGNGGVTSGKQAAINAALADVGNSYATGWNQPGECLVSVRRWLAAGGINFGYGGPNSGYVASGATQVSWSNVQPGDVVQYESAYSPDSWIGGVHTVLVTGVSGGSVQIVEANNPGGSGYVSSNSNWSPAPPAGFRAVVWRFPG

SEQ ID NO: 249 - protein, 178 aa, Enterococcus faecalis
MSSLLKRLVQLVLLVVAVLLIRHYVFSPAAVNGSSMEPTLHNNDRLWVTSIKKPQRFDIIAFPSPRNGQRVAKRLIGLPGETVEYRDDTLYINGVSLSEDYLASAKRNVSKNENYTQDFTLETLEATQSLTVPEGMYFVLGDNRPRSDDSRYFGFVKQASVEGVLTFRYYPLDKIGFP

SEQ ID NO: 250 - protein, 150 aa, Enterococcus faecalis
MANDDLQQRLDKGMYGTPLVNPEEQHKYMGTFRERCRLSMTVAEMKDAQNQKHLLEELAKHPEVTVLLNGEISSDLQSTYIKLLNQHGANFKIVNNFVENNPDSLGLLLAEKHAVDEPVIDVTEKYPQATETPKEEPTAKKSFWQKLFHS

SEQ ID NO: 251 - protein, 1192 aa, Enterococcus faecalis
VYLKRIEITGFKSFADKTIIEFEDDVTAVVGPNGSGKSNITEAVRWVLGEQSAKNLRGGKMNDIIFAGSEGRKPLNIAEVTVTLDNSDHYLALDYSEISVTRRLKRTGESDFFINKQACRLKDIQDLFMDSGLGKESFSIISQGKVEAIFNSKPEDRRGIFEEAAGVLKYKQRKKKAEQKLFETEDNLSRVQDIIYELEDQLVPLAAQADAAKKYLALKEELTEIDVNLTVTEIQEAKAIWETKTQELTAIEEKLAGASKQVHDLEGKLVRLRSKRNRLDEQIETEQQQLLQVTEALKQAEGQKNVLIERSKHTSQTASEYEETLAETAEKIVRYREELQTLETAIAEKTAQRQTLKEALALATKDVEKYSKSSKELMEELRSQYVEVMQEQANTANDLKYLERQYQQETAKNQQSLAKHEALEEQMVEALAMKETLEKEQKVAKQGLQEQLEEYTALKATLEAKRERLAQRQNDMYQAMNQVQQAKARQKSLQEIQENYAGFYQGVKAVLRHKNQLTGIVGAVAELIEVPKEYTLAIETALGGAAQHIVVENEKDGRAGITFLKQQHSGRATFLPLTTIKPRSVSAMVQNRLAGAPGFVGIASELVRYPEQVQTVIQNLLGVTILAADLTSANQLAKLVNYQYRVVSLEGDVMNPGGSMTGGANKRGNQGSLFSQAQELQTITEQMTQLETQLRSVEQEVQALSQEVKTATERAEMLRSAGEQNRLKQQEIDNKLANQTETITRLTKEKRLFEYESRELHQFLTEYQTKKATLTEQQANLTATKERLDAEMKQVEQEASQMETFKAQAQERLTTVQAEQAVAAEQCAHFARQKQDKQEQLDELLIRETAIRQQLQQLSSHSSDHQLTEEGLAAQVAQLAEKQTALQTSLQTARSQRQALQEEVDELDTKLAEENKRQQQYLADKTQIEVLKNRAEMQLDSSLSYLQEEYSLTFEAAYEAYFPIDDLAQAQQTVKRLKQEIERLGPVNLSAIEQFEQVDERHQFLVSQRDDLLNAKEQLFETMDEMDQEVKERFKEVFEAIRGQFKVVFPNMFGGGRAELVLTNPEDLLNTGIEIEAQPPGKKLQHLSLLSGGERALTAIALLFSIIRVRPVPFCILDEVEAALDEANVARFGHYLSEFEDGTQFIVVTHRKGTMEAADVLYGVTMQESGVSKIVSVRLEEVKEGGAIEKSN

SEQ ID NO: 252 - protein, 810 aa, Enterococcus faecalis
MQKVAKVIVDVPTMQTDQPFTYLVPENLNEQLAVGMRVEVPFGNGNRHVQGFVLAIEPVAATVLDETNVQLKELVAVLDLKPVLNTEMLALADYMKEKTFAFKITCLQTMLPSVMRADYQKYIYLTDELSEELQDQLFYGLEEISWDQAQERGLLPQLMALRKQQKVDIRYEVTTRNKVKMVRFIQAAKEFEQLEEIRLGLRKGAKKKEQLLYYLQRLGTEKVTAVKEMKELGFSTALLNEAAKNGWLTFIEKEAYRDPFANQTFEKTTALSLNAEQQVAVETILQSVQEQQSQTYLLEGITGSGKTEVYLQVIAEVLNQGKTAIMLVPEISLTPQMVQRFKSRFGEHVAVMHSGLSQGEKYDEWRKIERGEAEVVVGARSAIFAPIENIGVIIVDEEHEASYKQEETPRYHARDLAIWRSEYHHCPVVLGSATPSLESRARAQKNVYQRLRLTQRANQAATLPTIDVVDMRQEVENGNVSSFSMSLQEKLQERLEKNEQSVLLLNRRGYSSFVMCRDCGYVLPCPNCDISLTLHMDSKTMKCHYCGHEERIPYRCPNCGQDKIRYYGTGTQKVEEELQTLLPDSRILRMDVDTTRRKGAHEKILRTFGEGQADILLGTQMIAKGLDFPNVTLVGVLNADTALNLPDFRSSERTFQLLTQVSGRAGRAEKPGEVIIQSFNPEHYAIQLAKAQDYEDFYTKEMYIRHRGDYPPYYFTVQITASHPEENEAAKQMFQIATKLKQGLSPQAILLGPTPNAIMRVNNRYFYQVIIKYKQEPMLQPLLKEILTDTQRATARGLKLSIDAEPMNFI

SEQ ID NO: 253 - protein, 263 aa, Enterococcus faecalis
MDLHLTVDLKKTKTLIDLADQAHLIIEQTTKLPKKEAAILFLLIDNQLVALGLAEEKATYKEVSFDHSILLKPTWDTELAYLAQAFLDDAKESGLTLEATPTTVKIPKSAVATVTNYKETVTFILERFGYSLFKKPAPKKARPAKARHKWTKEVSQIPFYIDTRQSKATVFWQKRNEMLIKAGATMMPEAPLNKDGSVGFSARFGEKLRDERKGQFKDFVTTEDIVLKSVNEVGLFLYFAGTNSWLELVDENGKTLNEWTVVE

SEQ ID NO: 254 - protein, 358 aa, Enterococcus faecalis
MNRWKVYATVIACMLFGWIGVEAHASEFNFAVTPTIPENQVDKSKTYFDLKMAPGAKQTVEIQLRNDTDEDITIENTVNSATTNLNGVVEYGQNGIKPDKTLRFNLKDYVEAPKEIILPKHSQKTLPLTITMPKDSFDGVMAGGITLKEKKKETTTSADQSKGLAINNEYSYVVAIILQQNETKVQPDLKLLGVKPGQVNARNVINVSLQNPQAAYLNQLHLINTVSKGGETLYQSDTEDMQVAPNSNFSYPISLKGERLTPGKYVLKSTAYGVKDEKGTYQVKGANGEERYLYKWEFTKEFTISGDVAKELNEKDVTIKGTNWWLYLLIALIILALLLLIFFLYRKKKKEEEQQSEQ

SEQ ID NO: 255 - protein, 324 aa, Enterococcus faecalis
MSKNFWATLPKPFFVLAPMEDVTDVVFRHVVKEAGAPDVFFTEFTNSDSYCHPEGKDSVRGRLVFTEDEQPMVAHIWGDKPEFFREMSIGVAEMGFQGLDINMGCPVPNVAERGKGSGLILRPEVAAELIDAAKAGGLPVSVKTRIGFTEMAEMEAWITHLLEQDIANLSIHLRTRKEMSKVDAHWEVIPQIMAIRDRVAPQTTITINGDIPDRQKGLELAEQYGVDGIMIGRGIFKNPYAFEKEPKTHTPQELLGLLRLQLDLQDKYAELVPRSIVGLHRFFKIYVKGFPGASDLRAQLMNTKSTDEVRQLLATFETEHGVLD

SEQ ID NO: 256 - protein, 364 aa, Enterococcus faecalis
MRYLDAEAIENIATGAAFLGTGGGGDPYIGKMMALSAIEENGPVKLVSPEEIAAEDFFLPAAMMGAPSVAIEKFPKGDEFVRVFEKLGKYLDQETIAGTFPMEAGCVNSMIPIVVAAKLGIPLVDCDGMGRAFPELPMVTFHLNGMSATPMAITDEKGNIGIMETIDNTWTERLARVQTVEMGASALVSIYPATGKQLQDYGIHNIVTLSEEIGKVIRGTYADEQEKRQALVEVTDGFELFQGKILDVEREVKGGFNLGRVKLSGLNSDAGSEAVVHFQNENLIAEKDGQVIAMTPDLICMVDLETLTPVTTESLKYGKRVQVMGLKANAAWRTKKGIETVGPRYFGYEMDYQPLENLVAKEDK

SEQ ID NO: 257 - protein, 364 aa, Enterococcus faecalis
VTIVLLLLLNVSIMFLLGQLLSENSPLAGVIWATKDAVAKELNTDLFWSWNKFVLPIFFLVDAAVLYWRLIRRYHQMQLRHIISELHYIADGNYNHRIPFELSGDLAKVVTSINGLVDSTVAAIEDERRIEKSKDELITNVSHDIRTPLTSIIGYLGLIEDRQFHSQEDLLKYTHTAYVKAKQMKLLVDDLFEYTKVRQPSVPIHTTTFDMAQLIEQLAADFELEAKKINMQIQVKANPASLMMEGDTEKLVRVFNNLLSNALKYGKGGHHIVMEVDKVGTEAIIAVRNDGPAIPKHSLDQLFDRFYRVEESRSQETGGTGLGLAIAQSIVALHGGYIYAKSDQKWTSFIIHLPLQRTNKKSES

SEQ ID NO: 258 - protein, 229 aa, Enterococcus faecalis
MEAEALRAIVAENRQLEQNLTKRNEQYIFDLKKSLKAANLSEEELALALHGILPELVAGQKTGKTARQLFGTVSERTEAILNKPAEVKEPAGWMIWLDNTLLLLGLLTIMLAAMSLFSKGTAQPLGLTTYILGAMAGGYVFYLMHKYVYRFDRQGGDKSKRPGWLKTTAILFGGMFLWIAVFAGSAMLPPVINPILDPMIALVIGALAFVARYFFKKKYNIQGSFMTRQ

SEQ ID NO: 259 - protein, 431 aa, Enterococcus faecalis
MNLVLAEIAAMGLKNISIAPSSIANVHEPLIEHIKNGVVTNITSSGLRDKVGAAISAGIMENPVVIRSHGGRARAVAAGDIHIDVAFLGAPSSDAYGNANGTKGKATCGSLGYAMVDAKYADQVVIITDTLVPYPNTPISIPQTDVDYVVEIDAIGDPDGIAKGATRFTKNPKELLIAEYAAKIITHSPYYKEGFSFQTGTGGSSLAVTRFMREQMLKDGIKASFALGGITNAMVELLEEGLVEKIIDVQDFDHPSAISLGENANHYEIDANMYASPLSKGAVINQLDTAILSALEVDTDFNVNVITGSDGVIRGASGGHSDTSMACKMSLVIAPLVRGRIPTIVEQVNTVVTPGTSVDVVVTEVGIAINPKRTDLIDCFKTLDVPQFTLEELKDKAYNIVGTPEPIKYGDKVVALIEYRDGSLIDVVRNV

SEQ ID NO: 260 - protein, 228 aa, Enterococcus faecalis
MTMNPFKGKQFQQDVIIVAVGYYLRYNLSYREVQEILYDRGINVSHTTIYRWVQEYGKLLYQIWKKKNKQSFYSWKMDETYIKIKGKWHYLYRAIDADGLTLDIWLRKKRDTQAAYAFLKRLVKQFDEPKVVVTDKAPSITSAFKKLKEYGFYQGTEHRTIKYLNNLIEQDHRPVKRRNKFYRSLRTASTTIKGMEAIRGLYKKTRKEGTLFGFSVCTEIKVLLGIPA

SEQ ID NO: 261 - protein, 423 aa, Enterococcus faecalis
MNKKRIIFGLLSFFLPIFLVFGGLLFFLLLLTSTSDTSKNDCIQPSINNPTDATDTPKSIEQFVKSHKDAYLLSWKAGGFLPSASISQTMVENGFNFTNPSGTSFWQAHNMGGVKTSKKEDFPVTLATFGQDSVDISGTKPGSNVGDGTGGAYTWFKDYNAGIVGKAEFMAHQTLYTGAINNTDGLSTLSAIYSGGWATDPTYLMKLQATYNSLGKQFQWLDQEAIQKYGNAPFKKSELVLNIPGKSPITNEKYGKNSDCVVTSDTSDQVTGQNTAPSLEVPSAYKGKLTLPPIDSNDYAGNNYPFGQCTWYAYNRMAQIGKPIEWFSGDGGNGAGWANSARAKGYTVVKVKPSVGWAASMQGGIGGSAPPYGHVAVVEYVNSDGSILVSEANVINQGSGTRSWRVLDRATVEQIDFIQGKGA

SEQ ID NO: 262 - protein, 298 aa, Enterococcus faecalis
LNLQIKIKMEEIMMKKNLFASLFSATLLFGGSEISAFAQEIIPDDTTTPPIEVPTEPSTPEKPTDPTPPIEPPVDPVEPPITPTEPTEPTEPTTPTEPEKPVVPTEPTTPTEPTTPTEPSEPEQPTEPSKPVEPEKPVTPSKPAEPEKPVTPTKPTEPEKPVQPAEPSKPIDVVVTPTGELNHAGNGTQQPTVPIETSNLAEITHVPSVTTPITTTDGENIVAVEKGVPLTQTAEGLKPIQSSYKVLPSGNVEVKGKDGKMKVLPYTGEEMNIFLSAVGGILSVVSGFVIFKKRKAKV

SEQ ID NO: 263 - protein, 1296 aa, Enterococcus faecalis
MKQQTEVKKRFKMYKAKKHWVVAPILFIGVLGVVGLATDDVQAAELDTQPGTTTVQPDNPDPQVGSTTPKTAVTEEATVQKDTTSQPTKVEEVASEKNGAEQSSATPNDTTNAQQPTVGAEKSAQEQPVVSPETTNEPLGQPTEVAPAENEANKSTSIPKEFETPDVDKAVDEAKKDPNITVVEKPAEDLGNVSSKDLAAKEKEVDQLQKEQAKKIAQQAAELKAKNEKIAKENAEIAAKNKAEKERYEKEVAEYNKHKNENGYVAKPVNKTLIFDREATKNSKVVSVKAAEYIDAKKLTDKHKDKKLLISMLSVDSSGLTTKDSKKAHFYYNNGAGGTLVVLHKNQPVTITYGNLNASYLGKKIASAEFQYTVKATPDSKGRLNAFLHDDPVATIVYGINIDPRTKKAGAEIEMLVRFFGEDGKEILPTKENPFVFSGASLNSRGENITYEFVKVGNTDTVHEINGSKVARHGNKVYSKTDIDVGTNGISISDWEAVQGKEYIGATVISTPNRIKFTFGNEIVNNPGYDGNSMWFAFNTDLKAKSITPYQEKGRPKQPEKATIEFNRYKANVVPVLVPNKEVTDGQKNINDLNVKRGDSLQYIVTGDTTELAKVDPKTVTKQGIRDTFDAEKVTIDLSKVKVYQADASLNEKDLKAVAAAINSGKAKDVTASYDLHLDQNTVTAMMKTNADDSVVLAMGYKYLLVLPFVVKNVEGDFENTAVQLTNDGETVTNTVINHVPGSNPSKDVKADKNGTVGSVSLHDKDIPLQTKIYYEVKSSERPANYGGITEEWGMNDVLDTTHDRFTGKWHAITNYDLKVGDKTLKAGTDISAYILLENKDNKDLTFTMNQALLAALNEGSNKVGKQAWSVYLEVERIKTGDVENTQTENYNKELVRSNTVVTHTPDDPKPTKAVHNKKGEDINHGKVARGDVLSYEMTWDLKGYDKDFAFDTVDLATGVSFFDDYDETKVTPIKDLLRVKDSKGEDITNQFTISWDDAKGTVTISAKDPQAFILAHGGQELRVTLPTKVKANVSGDVYNLAEQNTFGQRIKTNTVVNHIPKVNPKKDVVIKVGDKQSQNGATIKLGEKFFYEFTSSDIPAEYAGIVEEWSISDKLDVKHDKFSGQWSVFANSTFVLADGTKVNKGDDISKLFTMTFEQGVVKITASQAFLDAMNLKENKNVAHSWKAFIGVERIAAGDVYNTIEESFNNEKIKTNTVVTHTPEKPQTPPEKTVIVPPTPKTPQAPVEPLVVEKASVVPELPQTGEKQNVLLTVAGSLAAMLGLAGLGFKRRKETK

SEQ ID NO: 264 - protein, 144 aa, Enterococcus faecalis
MKYERPLKRESQIKEFELGTHAAVIEKVQKKRSQKGNDMFLLSLLGKSNEKGVYFLTFGNDYTEDNLRYILASIQDNGVEIPDVDFGYNRETFEFLKGKDVYIQVEEQEYKGKVKHAVTNFLTQDEFEESEEMEFSESNTEEDW

SEQ ID NO: 265 - protein, 162 aa, Enterococcus faecalis
LVEQREIVHRYYVLGTSTLDKVLKVLLNLSSDGVLALKDKFLPLKGENNLYKLMNREDPLTSAQLHEKVNLNKLKEQLEAQGLPFAFKETKEGTNFYFRVKDTELAKKALERVLTDIKKNPQMILRKPNTMTFDERLAYTAANKKYVGKIDQTKAITKGRKL

SEQ ID NO: 266 - protein, 447 aa, Enterococcus faecalis
VRMNKKTPKPLTPPKAFFNWCTAQIPTYEWQNKKETILASSRKNCPIIKKRLTKYSRLSFPTKFYSFGIILVRAKRIEIQTHSYWQTITDGIENLIYEPSNLERFSNDTHVKAHYENGHWHEGLLANYGFMSSAYTNTVFYPNNWQEKLTTVSELKYLQLPEIERQELAHIYKYRNEIEFLQKIGATTLANEIIFDDYRNVFGLYFHKVDMRVITKKWLKANKQKLKTRNPTFHEFMLEKTLKERNAPMINEIEKYVHYSQIKQLPKEVNLTKFQKWFIRKGERFDYYMDYLHMLEELNTPLNNDSVLYPENLQVAHDNAMNTLNLLKSEIEEKQYQERKNQIKALEAEIDDLLFLTPHSLQEIIQEGSILRHCVGSQHYIERHTQGKTTIVFIRRKEKPDMPYFTLEYRNQQVIQIQGKCNRQEVPEKIKQAVRQWQENLQHALSS

SEQ ID NO: 267 - protein, 29 aa, Enterococcus faecalis
PSEKGNQGRVEKRSDAKSTNHVNAGRYTE

SEQ ID NO: 268 - protein, 71 aa, Enterococcus faecalis
ENEFKLHKIGLHSFLDRVHQSVVLGVRSLRSIKKKCNHYPQTEKQKQDKAGQAMRMRQGIVLGMCLIVLHS

SEQ ID NO: 269 - protein, 64 aa, Enterococcus faecalis
NIFSKSSAPIIRRFIRSMARWDVCFLDDRSLDAGASFDGFCLPNVCYRYVDWDVNYGSWWYGNV

SEQ ID NO: 270 - protein, 68 aa, Enterococcus faecalis
RGRCYIFNEVPRCWQENSPTNDFRFKRKIRRIRVFRSSGCGHDRNRSGDNKQSSIGRSVRSIKCPRLQ

SEQ ID NO: 271 - protein, 24 aa, Enterococcus faecalis
TRLWGRQLCRKSQIRKSSGINYRR

SEQ ID NO: 272 - protein, 32 aa, Enterococcus faecalis
LGLSFIKHVLAYGYVLWGNIHKRQIHWELMST

SEQ ID NO: 273 - protein, 37 aa, Enterococcus faecalis
HLVFVHVKDVNQPGKSFLTRNGLLKLSNLLIGIQRNH

SEQ ID NO: 274 - protein, 63 aa, Enterococcus faecalis
KTVVARQLRWKWRLQKQGLHRNKLGISMLMVRQPQRMTLRKQRPSNVSLVSEHRKFQFQVQRV

SEQ ID NO: 275 - protein, 20 aa, Enterococcus faecalis
CYSKFRQTSKQWPNKRRQGD

SEQ ID NO: 276 - protein, 40 aa, Enterococcus faecalis
VASPSKSAPFFTHAKKCQNQRRNSCFSFSSPSWRLCHLNV

SEQ ID NO: 277 - protein, 69 aa, Enterococcus faecalis
NKGRQPIYRKLQRAPLILKYLSPAQVNQLIHNQLQNQLATKWQVVAKKFLGKQVIRSNIKHGALVQSFV

SEQ ID NO: 278 - protein, 70 aa, Enterococcus faecalis
ESIKDFNNVSRKKQIKRVQSKWKIIFYSVVISLDSAVKPIGKFSDIFKEALFSNTTPKTKKSSVKEYVKI

SEQ ID NO: 279 - protein, 40 aa, Enterococcus faecalis
HLWLVLRYLPKQNQASKHLLMKSEIQQQPLPIAMICMLPS

SEQ ID NO: 280 - protein, 54 aa, Enterococcus faecalis
VMFRQNHRRDKKKKRRSEQRRKKPKLQNAKQKLKPLPNKNYKSGNAWNKRQPSA

SEQ ID NO: 281 - protein, 64 aa, Enterococcus faecalis
RIANWNLEYTNNLEVILLGKKGSKIKKKKRRLKEKAIANGTYSKRGKSDGMYKMQGTDDCLGKR

SEQ ID NO: 282 - protein, 40 aa, Enterococcus faecalis
KTNTALAGMATLAMMNGTTAKASSCPAPTIFPVAIMIRLR

SEQ ID NO: 283 - protein, 27 aa, Enterococcus faecalis
RLPAPPLRKTRSLPSMPKSWNRCSPKT

SEQ ID NO: 284 - protein, 79 aa, Enterococcus faecalis
GGGTHLKQYEIILADPPWRYSQKGGAGSGRTSLRHHEHGGFMLTAYQPFCCAGLRAFSLEYIPTASRSTASDSCMGIHL

SEQ ID NO: 285 - protein, 72 aa, Enterococcus faecalis
RKQLITVVYKSKIQRFMSAIHGNQKRTLFQQQIKQVKTFPSKKSLFQVKLITPKQAFIQLFTVTKVKKKQPM

SEQ ID NO: 286 - protein, 42 aa, Enterococcus faecalis
QELRIVVIQIQINQKRIRQQQMQAKKLKKYLILMLKLAIPSK

SEQ ID NO: 287 - protein, 32 aa, Enterococcus faecalis
LSWQSSASRRCFGNRDKSIPSSRWRKLSNVPT

SEQ ID NO: 288 - protein, 65 aa, Enterococcus faecalis
RNTQGKCRFSLRVSLFFGKVCRKVGSFAHELSIDFCRKPTNRNRTLDFKARHISRCRGYVRICFR

SEQ ID NO: 289 - protein, 47 aa, Enterococcus faecalis
FPSGLLFARGNVGAGSASGDSSIRGTVEHATFNGSRTSGGTESARSI

SEQ ID NO: 290 - protein, 74 aa, Enterococcus faecalis
NQRKKFNQNQNQSPLRKSQNRNNLRQPLRKIKKLRFLLKKKSLHPRKKTNLWRNRQCQKKKRNKQKKQRLIPYK

SEQ ID NO: 291 - protein, 28 aa, Enterococcus faecalis
QQVCLAPLSHSLRAWESSNANVKTSSLL

SEQ ID NO: 292 - protein, 65 aa, Enterococcus faecalis
AVMHDQKTNRQPLTQSTKKKPKNKQNMRSMVSLKILQNGTSGKLTMENLKIYYKKRNLLLTTKDF

SEQ ID NO: 293 - protein, 64 aa, Enterococcus faecalis
PNSCVYHMNDQRIKFQATKNKIGPKMLPPIAKEAPKAPNIGRTVNQKTGSPTPAKGPIIPTLTP

SEQ ID NO: 294 - protein, 51 aa, Enterococcus faecalis
IKCPTSRQLKHFFFHAFRQTCIPKAFNHINNGDYFFIISHFASVQIIRKVF

SEQ ID NO: 295 - protein, 28 aa, Enterococcus faecalis
RHISNGGTFLAVTEMAIDDFDSRTFQIF

SEQ ID NO: 296 - protein, 34 aa, Enterococcus faecalis
STLSIIALIFSKHCVVCSLIPPATNAFVLGSNGS

SEQ ID NO: 297 - protein, 90 aa, Enterococcus faecalis
NKSSAFSPAKRCPPLTTTCLAPICTIRFAASSISATEEISPKPDKMPASIKLGVATNANGSKSFFRPSTLLGCRICAVPLQAMTGSITTF

SEQ ID NO: 298 - protein, 48 aa, Enterococcus faecalis
LPLVVYNESNRKMDALENSCRQSRLSRQKQRPEWLFQLPLRIVLLHTK

SEQ ID NO: 299 - protein, 89 aa, Enterococcus faecalis
TSNDSIMIAKLSNSFFKKFRSRTKQLIAASDCRTKTNNVASNPRIVDQLAPNVPQRMVKKPVVSNFTNKPTPAATKGPLKRLRLCSILW

SEQ ID NO: 300 - protein, 72 aa, Enterococcus faecalis
SALMSTTRPSGLSNKVTIFTDAALRYLNKSTKYANVRPLSMISSTIKICLPSTFVSKSLTIFTSPEETVALP

SEQ ID NO: 301 - protein, 37 aa, Enterococcus faecalis
HVLQKYQRPQYLRYPRKIEPFPQFVICFLEFQPIQNL

SEQ ID NO: 302 - protein, 122 aa, Enterococcus faecalis
MSIITPADTFLNRLINVAADSFKPFLSNVPVANIIIIKIAMPRLFTKVVPSVSSIDVKPSPPVKAVTIKATITIKIASNFNAKPTMTINTPNKGNKSIKSLLLKIKFHFPLYANFRSFVRLF

SEQ ID NO: 303 - protein, 40 aa, Enterococcus faecalis
RLNRSVLSLVPLLAVLGDKQKNHLAFFVKAAAVSSLIVHH

SEQ ID NO: 304 - protein, 27 aa, Enterococcus faecalis
SVCIARHLPHLDELGHHKTNHHGRYYN

SEQ ID NO: 305 - protein, 58 aa, Enterococcus faecalis
VAPNKVSGRVVNTVKLSSVPATLKVTLAPSERPIQFRCISLILSGQSTSSKSSNKRSA

SEQ ID NO: 306 - protein, 78 aa, Enterococcus faecalis
MIPASIKMTRSATSFAKPISWVTTTIVIPSIAKFFITDSTSPTISGSKAEVGSSNSITSGRMAKARAIATRCCCPPES

SEQ ID NO: 307 - protein, 81 aa, Enterococcus faecalis
HNPMKIEAKNAGIASSKSVQLMSLKEANIIIPTKINAGAVACAGTIAISGEKRLLRANRIATTTDVKPVRPPAPIPAALST

SEQ ID NO: 308 - protein, 67 aa, Enterococcus faecalis
YFFVISTKYSSNNKFSSAGFFSYASVIFCKNCARIIQPARQIFAISPNGKSHPYSSEAARSCAKPCA

SEQ ID NO: 309 - protein, 25 aa, Enterococcus faecalis
PSSSINVTFVVVEPASIPKKVTPVC

SEQ ID NO: 310 - protein, 66 aa, Enterococcus faecalis
AIINDVRPFRSCCSPSCNNSSVFVSILEVASSKIKILGSASKARANEINWRCPAESVLPRSSTTVS

SEQ ID NO: 311 - protein, 43 aa, Enterococcus faecalis
SSSSGNTCGQKDSASQNNCSVTVPLNLGSSSSAKGKLATSAAV

SEQ ID NO: 312 - protein, 48 aa, Enterococcus faecalis
IIPASTGECKASMPNIVKANAIANVYNKLMMGLNNNEFIRIIATRVFK

SEQ ID NO: 313 - protein, 32 aa, Enterococcus faecalis
TNCIATPQAIPNFKSPKIMPQTNPPTKGRPIV

SEQ ID NO: 314 - protein, 37 aa, Enterococcus faecalis
YPFQIDKSTPWSPFAANVLIGDTKNKTTSNVANSFFF

SEQ ID NO: 315 - protein, 55 aa, Enterococcus faecalis
FFNDLRISIITFSLDISMPTKGSSKKITSAPWAKTRAINTRCNWPPESSPIWRCA

SEQ ID NO: 316 - protein, 22 aa, Enterococcus faecalis
FLHKSHCPVEPKKTVPVPSLIC

SEQ ID NO: 317 - protein, 22 aa, Enterococcus faecalis
DTNCCANSVAVTPTSSNRTMIV

SEQ ID NO: 318 - protein, 43 aa, Enterococcus faecalis
GSPSSSYRVSTITSRVRVYCREKMRSISGWTSAKVKALNAVER

SEQ ID NO: 319 - protein, 27 aa, Enterococcus faecalis
LLCHYCFFLIPQCDRNNRDSLCHVLGS

SEQ ID NO: 320 - protein, 113 aa, Enterococcus faecalis
KTIAKVNNATNQFRAEPKSALPAPPAIYLIATGNKDSPMLKITVPVTKGGNNTRIFLMNKPTIITRILPTNWEPKIAAIPKSAPMAIKIGTYAKLAPIITGNREPTFPKIGKS

SEQ ID NO: 321 - protein, 32 aa, Enterococcus faecalis
PTLILKMKPFGSPSSNSLLSNFKTNHALTYSS

SEQ ID NO: 322 - protein, 103 aa, Enterococcus faecalis
GTLSITVAPVCTMTAAESEDVPISKIAGPKEPVAKITAVDVEPTAKPIKIPEIGAKKVPEIPITEIKWTICVDKSETEINPAIAPAPIKIKTVSVTLFKPEDA

SEQ ID NO: 323 - protein, 62 aa, Enterococcus faecalis
TKSRANVDTLQEIYTIFLGGCFKRAVNNLRSKPVRGGSTTMASGLKPSLNHLGNKSSAVPTA

SEQ ID NO: 324 - protein, 50 aa, Enterococcus faecalis
LSCETKKSTGPSLLTVCILIVYTKTITPIPLKAVAINKVKPVSVLLLLNK

SEQ ID NO: 325 - protein, 52 aa, Enterococcus faecalis
FLFSLPVRREPPLKFHKQSSVLAPFVPITTIILQNQHLQQKLVLNRQRHTFG

SEQ ID NO: 326 - protein, 36 aa, Enterococcus faecalis
NKPAKNAPKTAPVNANGGIPKNVIRIKPQTSAMSVP

SEQ ID NO: 327 - protein, 60 aa, Enterococcus faecalis
INSQIAPMPINCLNLCADIIKSNHIQNNMHKSNVKKHWRDKPPVFMILSYQWTNHCSPIN

SEQ ID NO: 328 - protein, 22 aa, Enterococcus faecalis
FSFSLYEFPHKKRQIIQQDRRR

SEQ ID NO: 329 - protein, 95 aa, Enterococcus faecalis
AKNALIPKAGAVAIGYFANTPIKIQPKALAKAVAVKTAPSSMPEAPSTVGLTNKIYAIEINVVKPANISRFIFVFNCSSSKYELIFSFMFRPPKI

SEQ ID NO: 330 - protein, 90 aa, Enterococcus faecalis
LFSDTFSISLTAFVSLNSIIGNSRRNSDCKINEELIPLGQTISAFSFSCRCSFFCPKISPPNNMVKKPISSDGIDRFVNFSKGANACSQR

SEQ ID NO: 331 - protein, 28 aa, Enterococcus faecalis
INSHSIQRVIRVPCPKSSSGSKKSSSVS

SEQ ID NO: 332 - protein, 64 aa, Enterococcus faecalis
VNQCLKRQIYRHIFLIHHSSGSCALLPFCNNFPYKINAPNKLNHHTERGIQMKDLFNHQLTKHQ

SEQ ID NO: 333 - protein, 175 aa, Enterococcus faecalis
SAISIFSVPELMYKVTDRPFFTDDFASGSVLTTLPSSILSSGIFLVSLSTFSPALFSACEASAFVSFVTSGTSTSLPPDIAKAKPPIAKEINAAIAKPIHNFLRFFFGGCSAKMSSAISSGTSTGVVSSGSAMSSGIGVNTFVSPNKAVGSHAGSFKRLADKDVYKSSAISFAVL

SEQ ID NO: 334 - protein, 24 aa, Enterococcus faecalis
GSPPPPVPKKAAPVAIFSIASASK

SEQ ID NO: 335 - protein, 25 aa, Enterococcus faecalis
SPAITAPNAKEPTVIERPDIKLPAV

SEQ ID NO: 336 - protein, 68 aa, Enterococcus faecalis
IRSRNDRLASGTLISFSVKCNTSANKMEKPMPNNIQPLMNGIFASGMLVLAPIAVTITPKKAPGFEIS

SEQ ID NO: 337 - protein, 87 aa, Enterococcus faecalis
MFVNIGMNPIFIDRKAIKTDTIGATAIGINNKGLKITGSPKIKGSLMLKNAGTNEIFDMAFILDECPTMAIAIAKPIVQPAPPIVAN

SEQ ID NO: 338 - protein, 27 aa, Enterococcus faecalis
QANSVRPMNSHAHLQADSNNPLLHVLD

SEQ ID NO: 339 - protein, 40 aa, Enterococcus faecalis
VKLPVPSFEISCAFCSRLAHPDNSKVAAVSSSHFFPINSF

SEQ ID NO: 340 - protein, 122 aa, Enterococcus faecalis
VIQQESRLRVADNSGAREILTIKVLGGSGRKTANIGDVIVATVKQATPGGVVKKGEVVKAVIVRTKSGARRADGSYIKFDENAAVIIRDDKSPRGTRIFGPVARELRENNFMKIVSLAPEVL

SEQ ID NO: 341 - DNA, 990 bp, Enterococcus faecium
atggtagggattatcctagcaagtcatggacaatttgctgaaggaatcttacaatccggttcaatgatctttggcgaacaagaaaacgtcaaagccgtgattttgaaaccaagtgaaggtccagatgacttgagagccaaattggaagaagcggttgcttcttttgataatcaagacgaagtgttattcttagttgatttatggggcggaacaccgttcaatcaatcaaacacattattcgaagagcacaaagataaatgggcaatcgtcagcggtttgaatttaccaatgttgattgaagcctacgcatcacgcttttcaatggaatctgctcatgaaattgcagcacacatcattgaaacagcaaaagacggtgtaaaagtaaaaccggaagaattagaaccggcagaagcaccgaaagcagcagttgaagacgcacaacctaaaggagcacttccagaaggaactgtggtcggagacggaaaaatcaaatatgtattagcacgtgttgactcacgtctgttacatggacaagttgcgacagcttggacaaaagcagtgcaaccaaaccgtattatcgttgtttcagatgcagtatcaaaggatgatctgcgtaagagactaatcgaacaagctgctcctccaggtgtaaaagcaaatgttattcctattagcaaaatgatcgaagtagcaaaagaccctcgttttggaaataccaaagcattgcttttatttgaaaatcctgaagacgtattgacagctgttgaaggtggcgtagacatcaaagaattaaatgttgggtcaatggcgcattcggtcggtaaagtcgttgtaagtaaagtattgtctatgggacaagaagacgttgaagcgtttgagaagcttgaacaaaaaggtgtgaaattcgatgtacgtaaagtacctaatgattcacgcgataacatggatgatattttgaaaaaagcaaaagctgaattagcaaaagcgtaa

SEQ ID NO: 342 - DNA, 1107 bp, Enterococcus faecium
atgattattaaagaagagatttttgtacctaaagaattagtgaaagaaaaaattgacctgctcgttgaaaacctgacaacgatcaaagacgataatggtgaatttttgttggactttgatggactgaaagtagatgacaaaagctggacagtgtggaattggccacaaggtgtcggtctatatggtatttataaaaattaccagatgacaaaaaatcctcgcgcttatcaagtggtcaatgaatggtttgaggatcgtatggaagaaggcgctccgcccaaaaacgtcaatacaatggcaccgctattgactatggcttacttgtatgaagacacgaaagattcacgctatttgccttatttagaacaatgggcagaatgggtcatgaatgacatgcctcggacaaatgaagacgggttacagcatgccacatatggaccggaaaataagaatcagttgtgggacgatacattgatgatgacagtgcttcctttggcaaaaatcgggaaactgttgaatcgcccagaatatttagaagaagctcgttaccagtttatgatccatatcaaatacttgatggataaacgaacaggattgtggtatcacggctggacgtttgaaggaaatcataactatgccgaagcattttgggctcgtggaaactgctggttgacgattgctattccagagatcattgaaatcttagaattatcgaaagaagatgcattgcgcaaattattgatcgaaacacttgaagcacaagtgcgtgcattaaaaacttatcagtctgaaagcggtttatggcatacgttgttggatgatccttcttcttacgtagaatcttctgcaactgcaggatttgcttacggtattttgaaagcggtccataaacgttatttaccacaagaatataaagaagtcgcttatcgtgctatccaaggattgcttgaacaaatcgatgaaaaaggagaagttcaaaacgtttcaatcgggacaggaatgggggacagtttagatttttatcggaatatcggaatcacagcaatgccttatggacagtcgttaacggtgctttgtttgacagaattgctcgtctcttattgttaa

SEQ ID NO: 343 - DNA, 939 bp, Enterococcus faecium
atgaaaatagcaattgcaggcgctggcgcaatgggaagtcgctttgggttaatgcttcaccaaagtgggaacgaagtattattaatcgatggctgggcagaacatgtccaacaaatcaaagagcatggattacaagcaaattttaatggtaaagaggtagaagcaaaactaccaatcgttcttcaatccgaagtagaaaaagaagatcaagttgatctgattattctatttaccaaagcgatgcagctggaaaaaatgctgcaggatatccaatcattaatcaaaaaagatacagaggtcttatgtctattaaatggtatcgggcatgaagatattattgagaaatttgtaccaatggaaaatatctatattggaaataccatgtggacggcaggtcttgaaggtcctggtcaggtcaaattatttggaagtggttcagtagaattacaaaatttaggtgatggaaaagaagcagctgcaaaaaaattagcagacaaattgtctgaatcaggattaaatgctcatttttctgacaatattcactattctatttatcgcaaagcatgtgtgaacggaacaatgaacggactatgcacaatcttagacgttaatatggctgagctaggaaaaacatcgactgctcataaaatggtggcgacgattgtcaatgagtttgccaaagtagcagcagtagagaagattgaactagatgtcccagaagtcattgcacattgtgaatcttgttttgacccggaaacaattgggttacattatccttcaatgtatcaagacttgattaagaaccatcgattaacagaaatcgattatatcaatggcgcaatttctagaaaagggaagaaatatggtgttgcgacgccttattgtgatttcttgactgagcttgtccatgcaaaagaagatagtttgaacgtaaaataa

SEQ ID NO: 344 - DNA, 957 bp, Enterococcus faecium
atgacttttccttattcagaaggaaataaaagatatcattcttggaattacgctttacgaaatgagtttggcgggaaaattttcaaggtgccgatcgatggaggatttgactgtccgaatcgagatgggactgttgcccatggcggttgtactttttgcagtgtatctggttcgggagacatgatcgttgcacctgaagaccctcttccaatccaattccagaaagaaatcgacatgatgcatcaaaaatggcctcatgtccaacaatacatcgtttatttccaaaattttacaaacacccatgcgccagttgaaataatcaaagaacgatttgagcaagtagtcaatttaccaggtgtcgtaggattatcagtcggtacacgaccggattgtctgccagatgaagtagttgattaccttgctgaactgaacgagcggatgtatttatgggtagaacttggattgcaaacaacttttgaagaaacttcaaaactgatcaaccgagcacatgattatcaaacttatttagatggcgtggctaaattacgcaaacataatatccgtgtttgtacgcatttgatcaacggattaccaggcgaaagtttagaaatgatgaaagaaaatgtcagacgcaccattttagattcagatatccaaggaatcaagctccatttgatgcatctgatgcgcaaaacgagaatgttgcgggactatcatgaaggtcgccttcaattaatgagccgtcctgactatgtcaatgtcatttgcgaccagctggaaatgataccaaaagagatcatcatccatcgtttgacaggggatgcgccgtgggattccttgattggaccaatgtggagcttgaaaaaatgggaagtcttgaatgcaattgatgaagaacttcttcgcagagatagcttccaaggaaaatatgatgtacggaaaaaggtgagcgtctga

SEQ ID NO: 345 - DNA, 1326 bp, Enterococcus faecium
atggcaaaaacaggaatgtatgtaggccttgatattggaacgacatctgttaaagttgtcgtggctgaatatatcgacagccaaatgaatattattggagtaggaaacgcaaaatcagaagggattaaccgaggcattatcgttgatatcgataaaacggtccaagcgatacaacgagcagtacgacaagcagaagaaaaagcaggtatccagatcaaaggcgtaagtgtcggtttgccagcaaacatgcttgaagtagaaaattgccagggaatgattgcagttaacggagattcaaaggaaatcaccgatgaagatgtcagaaatgtggcttcagctgcccttgttcgttcaatacctcctgaacgtcaaatcgtgtcaatattgccacaagattttactgtcgatgggttcgagggaatcaaagatcctcgtggaatgatcggcgtaagattagaaatgtacggtctgttgtttacaggacctaaaacgatcatccataacatacgtaaatgcgtggaaaatgccggattaatcgtcaacgaaatggtgattactcctttagcgctgactgaatcaattctttctgacggagaaaaagattttggtacgatcgtcattgatatgggtggcggccaaacaacaacggctgttatgcatgataagcaattgaagtttaccaatcttgaccaagaaggtggcgaatttgtcactaaagatatctctattgtattaaatacgtcatttaacaatgcagaagcgttgaaaataaactacggggatgcatacccagaacggacatcaccagatgaagaatttccagtagatgtgattggtcagtcagaaccagtgaaagtcgatgaacgctacttgtcagaaattatttcagctcgaatggaacagattttcaacaaagcaaaagatgcattggaccaaatcgaagcattagagttgccaggtggcgtcgtattgacaggcggagctgctagtcttcctggtgttgtggacttggcacaagaaatcttcggcgtaaatgtaaaattgtatgttccaaatcacatggggctgagaaacccggtatttacaaatgtaataagtatcgtggattattcagcaaacttgagtgaagtgtatcaattggcaaaaattgctgttacgggtgaaacctcagcagctcgtcaaatggtagttgaacaagaaacaacaaacacatatgagagctatgaagcacctgaagaaacaatctacgatgagccggaaccaaaagagtccggagaaaatgtaaaaaataaaatcaagggtttctttacaaatatttttgattaa

SEQ ID NO: 346 - DNA, 318 bp, Enterococcus faecium
atggcaaaaaaaacaatcatgttagtttgttcagcagggatgagtacgagtttattggtcacaaaaatgcaaaaagcagcagaagaaaaagggatggaagccgatatttttgcggtctctgcctcagatgcagataataatttagaatctaagaatgtcgatgtattattattaggtcctcaagtacgtttcatgaaagctcaatttgaacaaaaacttgcgcctaaaggtattccattagatgtcatcaatatgcaagactatggcatgatgaacggagaaaaagttcttgcacaagcagaaaatctaatgaaataa

SEQ ID NO: 347 - DNA, 1878 bp, Enterococcus faecium
atgaaaaatcataaaaaaataaacgttatgttaggagtccttttccttattttaccattactcacaaacagcttcggcgcaaaaaaagtgtttgcagaggagacagcagctcaagtcatccttcataaaaagaaaatgactgatttacccgatcctttaatccaaaacagcgggaaagaaatgagcgaattcgatcaataccaaggattagccgatatttcattttcagtttataacgtcactcaagaattttatgcgcaacgagataaaggagcgtccgtggatgcagcaaaacaagcagtccagtctttgactcctggtacaccagttgcttcaggaacgacagatgctgatggaaatgtcactttatctttacctaaaaaacaaaatgggaaagatgcagtctacacgatcaaagaagaaccaaaagacggagtgtcagctgccgcaaacatggttttagctttccctgtatatgagatgatcaaacaagcagatggctcttataaatacgggacagaagaactagatactatccatctctaccctaaaaatacagtcggtaatgatggaacgttgaaagttacaaaaatcggtactgccgaaaacgaagcactaaatggagcagaatttattatttctaaagaagaaggaacaccaagcgtcaaaaaatacatccaaagtgtcacagatggattgtacacttggacaactgatcaaaccaaagccaaacatttcattactggtcattcttatgacatcggcaacaatgactttgccgaggcatctattgaaaaaggccagttgatcgttaatcatttagaagttggaaaatataatttagaagaagtaaaagctcctgataatgcggaaatgattgaaaagcaaacaatcacgccttttgagatcctggcaaatagccaaacaccagtagaaaagaccatcaaaaatgatacgtctaaagttgataaaacaacacctcaattgaatggaaaagatgtcgcaatcggtgaaaaaattcaatatgagatttctgtcaatatcccattaggtatcgctgataaagaaggaacgcaaaacaagtacacaacattcaaacttatcgatactcatgacgctgctttaacatttgataatgattcttcaggaacgtatgcttatgccttatatgatggaaataaagaaatcgacccagtaaattattctgtcactgagcaaacagacggattcacggtttcagttgatccgaattatattccttcattaactcctggcggtacattgaaattcgtttactatatgcatttgaacgaaaaagcagatccaaccaaaggattttctaaccaagcaaatgtcgataacgggcatacaaatgatcaaacaccaccgtcagtcgatgtcgttactgggggcaaacgatttgttaaagtagatggtgacgttacatcagaccaaacacttgctggagcagaattcgtcgttcgtgatcaagatagtgacacagcgaaatatttatcgatcgacccatccacaaaagccgtcagctgggtatcggcgaaagaatcagcaacggtttttacaaccacaagtaacggtttaatcgatgtgacaggtctaaaatatggcacgtactatctggaagaaacgaaagcgccagaaaaatatgttccattaacaaaccgtgtagcatttactatcgatgaacaatcttatgtaacagcaggacagttgatttctcctgaaaaaataccaaataaacacaaaggtacacttccttcaacaggcggtaagggaatctatgtgtatatcggtgcaggagtagtccttctactgattgctggactgtactttgctagacgcaagcacagtcagatttag

SEQ ID NO: 348 - DNA, 2361 bp, Enterococcus faecium
atgaataaccgaatccttgaaacattggaatttgaaaaagtcaaacagatggtcagacaatttgtagtgactgcacaaggaaaagaagaactggcagaattggtaccagtgagtgagaaacaaacgatcacaaactggcttcaagaaactgaggatggattgaaagtgcaacgtctgcgaggcgggatccctatacctaaacttgaaaatatccgtccccatatgaaacggatcgagatcggagcagacttgaatggagtggagcttgcacaagtttccagagtattgtctacgacaagcgaattgaatcgtttcattgatgatctttctgacagtgaaatcgaatttgcacgtttgtatatgtgggcagatcagttagtcacgatccctgttttgagccgccgtttaaaggaagcaatcgatgaagacggacgcgtgactgatgacgcttctcctgagttaaagagcataagacagaacattcggcgaagtgaacaagctgttcgtgaacagttagatgggatcgtccgtgggaaaaatgcaaagtatttaagtgatgcgatcatcaccatgcgaaatgaccgctacgttatcccagtcaaacaagaataccgcggtgtatttggcggtgtagtccacgatcaaagtgcttcaggacagactttatttattgaaccaaaacaagtggtggatttgaataatcgtttgcgtcaataccaaatcgctgaacgaaatgagattcaacgtattttaagtgaactttctgctgaacttgttccccatcgtcaagaaatcatccacaatgcttatgtgattggtaaaatggatctgatgaatgcaaaagcacgatttggtaaagaagtaaaagccatcgtgccgggaatcagtgaagacaatcatgtcgtcttgaaacaagcaagacatccactgatcgatcaggaaaaagtagtttctaatgacatcacaatcggaaaagactatcaagccatcgtcattacaggacctaacacaggtgggaaaacgatcacgttgaagactttaggtctgttacaactgatggggcaagcaggattaccgattcctgcaggtgaagaaagtcaaatcggtatttttgaggaagtatttgcggatataggagacgaacagtcgattgagcaaagtctatcgaccttttcttctcatatgacgaacactgtagatattttatcaaaagtcaatgaaaaaagtctggtattatttgacgagctcggtgcaggaacagatccgcaagaaggtgctgctctagcaatcgcaatcttagatgatcttggtaaaaagtctgcttatgtgatggcaacaacgcattatcctgaattgaaagtttatggatacaatcgggcaaatacgattaatgccagcatggagttcgatgtggatacactaagtccaacgtatcgtttgctgattggcgttcctggacgaagcaatgcgtttgaaatctctagccgattaggtcttgatacagaagttattgatgaagcgaagcagttgatgaatgatgagagccaagatttaaacgaaatgatcacagatttagagaatcgccggaaaatggcagagaccgaatatctggaaatgcgtcattttgtttctgaggcacaagaacttcacgatgatttgaaagaagcttacagctatttctttgaagaacgtgaaaaagaaatggaaaaagcaaagaaaaaagcaaacgaagtcgtgtcagaggcggaagaaaaagcagaaaaaatcattgctgatattcgtaaaatgcaacagcagattgggcaaggaaatgtgaaagagcatcagttgatcgatgcaaagacccaattagcaaatctacatcaagaagaaactttgaagaaaaataaagtattgaagaaggcgaaagaacaaaaaacgttgaaaccgggagacgaagtgttggttacgacttacggccaaagagggacgcttttacgtaaaaacgggaatcagtggcaagtagaaatcggtatattaaaaatgaatgtgtccgaagacgagctgacgcctgttgctcctcaaaaagagccgacacaacgagttatccatgctgtacgatctgaatctagtagtcacgtgccgaatcaattggaccttcgaggaaaacgatacgaagaagcgctaagtgaggtagatcaatatttggattctgccattctagctggttatcctcaagtgactattgtccacggaaaaggaacaggcgcacttcgcaagggaattactgattatcttaaaaaccatcggagcgtcaaaagctttgagtttgcaccggcaaaccaaggcggaaatggtgcgacaattgttaaatttaagtaa

SEQ ID NO: 349 - DNA, 954 bp, Enterococcus faecium
atgttcgatggctactgttcacgtgtcgtaaatggcaatccaaacgttaaaccagcaacaagaaaaaaagtcttggaagtcatcgatcgcttggattatcgtccaaacgcagttgcgcgtggcttggcaagtaagaaaacaacaacagttggggtaatcatccctgatgtcagcaatatgttctttgcttctttagcacgtggtatcgatgatgtggcaacaatgtacaaatacaatattatcttagcaaattcagatggcaacgaccaaaaagaagtcaatgtattgaataacttactggctaagcaagtggacggcgtgatcttcatgggtcaccatatcacagacgaaatccgtggagaattttcacgttcaaaaactcctgttgtattagctggctctattgatccagatgaacaagtaggtagcgtaaacattgattatgtatccgcaacaaaagatgcagtaaataaattggcaaaaagcggcaataaaaaaatcgcttttgtcagtggtgcgttgatcgatcctatcaatggacaaaatcgtctgaaaggctataaagaagcattaagcgaaaataacctaccatatagcgaaggattgatctttgaagcacaatacaacttcaaagatggtctatctctagccgatcggatccataatagcggtgcaacagctgtctatgtttcagatgatgaattagccatcggtattttggatggtttattagatcgtggcgtgaaagtaccggaaggattcgaaatcatcacaagtaacaattcactactgacagaagtagctcgtcctcgtttaacaagtatcacacaaccattatacgatttaggggcggtatctatgcgcctattgacgaaaatgatgaataaagaagaagtcgaagaaaaaacgattatcttgccttatggaatcgaagaaaaaggatctacaaaataa

SEQ ID NO: 350 - DNA, 645 bp, Enterococcus faecium
atgaaaaaaattgatattttatctcgattgaaaaacgccggagtgattgcggtggtacgcggaaaaagcaaagaagaagctttgaatgcttgccacgcaatcatcaaaggtggtctaactggtattgagttgacttttacagtccctcaagcagatcaagtaatcaaagaacttttgtcattctacaaagaccaaccagaaatagtgattggcgcaggcacagtattagacgctgtcacagctcgcttggctatcttagctggcgcagagtatattgttagcccttcctttgatcaagaaacggcagagatgtgcaatctgtatcaaattccttacttaccaggatgtatgactattaccgagatcaaaacagcgctgaaaagcggggtagatatcgtcaaactatttcctggaagcgcttatggaccaagtatcatttctgccttcaaggcgccgatgcctcaagtcaatatcatgccaactggcggtgtgagtctggacaatatgaaagagtggttcgatgctggtgtcgtaacagtcggagtaggtgggaaccttttagcacccgcagctacaggagattttgacaaagtaacggaagtcgcgcaacagtatgcagcaaaaatgaaagaaatcaagaggtag

SEQ ID NO: 351 - DNA, 4266 bp, Enterococcus faecium
atggatagtgtagtggtccatcgtaaatcgcgtttatgggaatttacgctgcatttttccaaaattttgcctattatgctatatcggtcattgactcagcatctgactatcgcttttaaagatattgcacaagtcaaactgaatatcttagcagatgaccagacattcgatgaacagctcttgcaagattactgggcccaagctttggaaaatcagcaatgcgatacaccactagcacagcaagtattgaaaacgcaggtacctgtgataaaagatcgtaaagtcatcttgccaatcgacagtacaggagctatttcttatttgaagcaacaatacttgccattagtagaagagttgttcgtcagttacggattcccaaaatttcgtatcgaaccagaagtggatgagcagcaagcggaacgagtattgaaactttttgaagaacgcaaacaagaacaggcagaagcctttatgaagcaagcagctgaaagtctagttgtccacgaacaaaagaaaaaggaaagaaaagagcaatcgccagctcttgaaggacccatccacatccagctaggacgaaatattccagccgatgaaccaacgacaccaatgatcagtatcgttgaagaagaacgaagagtcacacttgaggggtacgtattcgacaaagaagtcagagaactacgttcaaaacgcaagatcttgactttgaaaatcacagattatacttcatcatttatcgtcaaaaaattctcgaacggcgaaaaagatgaacaagtatttgatgcgatcagtgtcggtagctggttaaaggtacgaggaagtattcaagaagatacgtttgtccgtgatttggtcatgaatgcgcaagatatcatagaagtcaaacatacacctcgcaaagattatgctcctgaaggggaaaaacgagtagagcttcatgttcatagcaatatgagtacgatggatgcaacaaacagcatctctgatcttgtggcacaagcagggaaatggggacaccgagctatcgccattacagaccacggtggtgcgcaagcctttccggaagcacatagtgctggaaaaaaagcaggtgtgaaaatcttatacggcgtggaagcgaatgtcgtagatgatggtgtcccaattgcttataatgatgcacatgaagcattgagtgaagccacatatgtcgtatttgacgtggaaacgacaggattgtctgcagtatatgacacgatcatcgagctagccgcagtcaaaatgtataaaggaaatgtgatcgaaagctttgatgaatttatcgatccaggacatcctttgtcacgaacaacggtagatctgactggtatcacggatggaatggttcgaggatcaaagtcggaagaagaagtattgcggatgttccttgaattttcaaaagatacaattttggtagcccacaacgcggcttttgatatggggttcttgaatactagctacgcaaggtatggtattcctgaagcggccaatccagtcattgatacgttggaattagctagatatctgtatcctcaattcaaacgtttcggattaggtgtgttatctaaaaaatttggtgtcagcttggaacagcatcaccgagcaatctatgatgctgaagcaactggtcacttagcatggatctttgtgaaagaggcaatggacaatcataacatgctttatcatgatcagctaaatgagcatatcggagaaggagattcttacaaaagggctcgacctttccatgtaacgattttagcaaaaaatcaggcaggactgaaagatttgttcaaactgatttcaatgtcgaatgtcgaatacttcgaacgcgtcccacgaataccacgctcccaattgaaaaagatgcgtgaaaatctattgatcggctcagcttgtgataagggagaaatattcgaagccatgatgcaaaaaggggtagaagaggcaagaaaccgagcaaaattctacgattatattgaagttatgccaaaagcggtctatgcgcctttgatcgagcaagaattggtaaaaaatgaacatgatttggaagaaattatccaaaatttggtagaaatcggaaaaagtttggataaaatcgttgttgcaacaggtaatgtacattatctgaacgaagaagatgccatttaccgaaaaattttgatcaattctatgggcggagcgaatccgttgaatcgtcatagtttgccggatgtccatttccgaacaaccgatgagatgctaactgcatttcactttttaggggaagaaacagcgaaagagatcgtagtagaaaatacgaataaaatcgcagatatctgcgaagaagtgattccagtcaaagatgaactttatacaccgaagattccaggttcagaagatgaaatatcagaattgagttacacaaaagcaaaacaaatgtacggagatccgttacctgagatcattcaaaaacgattaaaaaaagagttgaattctattaatggtaatggcttctcggttatttatctgatcgcccaaaaactagtgcataaaagtaatgaagatggctatctagtaggttcacgtggctctgttggctctagctttgttgcgacgatgacaggaatcactgaagttaatccgttagcccctcattattattgtccagagtgccaatattccgagttttttgaagatggtacgtatggttctggatttgacatgccagaaaaacaatgtccaaaatgtggtgcacgcttaaacaaagacggtcatgatattccatttgagacatttttaggattccatggagacaaagtgcccgatattgatttgaacttctcaggtgattatcaagcagaagcccataactatacgaaagtattgtttggcgaagactatgtttaccgtgccggaacgattggtacagtcgccgacaaaacagcatatggctatgtaaaaggatacgaaagggacaataatctgcagtttcgaagtgcagaagtcgacagattagcaaaaggcgctactggagtcaaacggacaaccggccagcatccaggggggatcatcgttattcccgattatatggatgtctatgattttacgccgatccaatatccagcagacgatcaaaattcggaatggaaaacgactcattttgattttcactcgattcacgataatgtattgaaattagatattctagggcatgatgacccaactgttattcggatgcttcaagatttatcagggatcgatccacaaacgatccctacggatgacccggaagtgatgcggatatttgccggtcctgaagtacttggagtaagtcaggaacaaatttattccaaaacagggacattaggtattccagaattcggcactcgttttgttcgagggatgctagaagaaacgcatcctacaacttttgcagaactactgcaaatttccggactatctcatggtacagacgtatggttaggaaatgcggaagaattgattcgacgaggagatgcgacactggcggaagtaatcggctgtcgtgatgatattatggtttatttgatccatgctggattagatagcgggatggcatttaaaatcatggaaactgttcgtaaaggacaatggaacaagatccctgatgaattgcgagaaacctatctatcggcgatgaaagaaaataatgtgcccgactggtatatcgattcttgttcaaaaatcaaatatatgtttccgaaagcccatgctgcagcttacgtattgatggctcttcgtgtcgcttatttcaaggtttatttccctattttgtattactgtgcatacttttctgtacgtgcagacgactttgatctagtctccatgtgcaaaggaaaagatgctgtgaaacaagcaatgaaagaaatcacggacaaaggattagatgcttccgtaaaagaaaagaatcaactgacagtgctggagttagccaatgaaatgctggaacgaggattcaaatttggaatgattgatttgtataaatcggatgccgttaactttgttattgaaggtgatacgttgatcgcaccatttagagctgtcccaagtttgggaaccaacgtggcaaaacaaatcgttgaagcaagaaaagacggtccatttttatccaaagaagatcttgccacccgcggtaaagtttcaaaaacattgatcgaatatatgaacgacaatggcgtattgaaagatctaccagatgaaaatcaattatcgttattcgatatgctataa

SEQ ID NO: 352 - DNA, 396 bp, Enterococcus faecium
atggttttatgggtaattaatatcattttgctattgattgtgcttgcaatcatcctttgggaagtctatctacgagtaatggccaaacgttcagcaacgactttgacagaagaagaatttcgagaaggaatgagaaaagcacaagtaatcgatgttcgcgaaaaagatgtgtttgatgctgggcatattttaggtgcaagaaacatcccttacactgttttgaaagattcattaggatctattcgaaaagaccagcctgtctatatttacgatcaaaagaaaagtttgagcatccgtacagcaaataaattacgtaaagcaggttatcaagagatttatttacttaagggtggatatgacggatggtctggaaaaatcaaaagtaaaaaagtataa

SEQ ID NO: 353 - DNA, 1941 bp, Enterococcus faecium
atgataaaaattacttttccagatggtgcagtcaaagaatttgagtctggaacaacaacattggcaattgctgaaagcatttcaaaaagcttagcaaaaaaagctttagctggtaaagtgaacggaaaactcgttgatttgactcgtccaatcgaggaagatgcaagtattgagatcatcacaccagaccatgaagatgcacttggcttagtccgtcattcagcagctcatttgatggcccaagccatgcgtcgcctctatccaaatatccactttggcgttggaccagctatcgattcagggttttactacgatacagataatggacaaaaccaagtaactgcagaagatttgccggcaatcgaagcagaaatgatgaaaatcgtcaaagaaaatctgccgatcgaacgccgtgttctttcaaaacaggaagcattagaaatttttgcaagtgatccgtacaaagtagaactgattagtgaattgccagaagaagaagtgattactgcttatcaacaaggcgaattcatcgatttgtgtcgtggaccacatgttccatccactggccgtatacaagtatttaaattattatcagtggcaggtgcttattggcgtggaaactcaaacaatcaaatgatgcaacgtgtatacgggacagccttttttgacaagaaagctttgaaagaatatatccgtctccgtgaagaagcaaaagaaagagaccatcgtaaactaggaaaagaacttgacttgttcatggtttccccagaagtaggttctggtttgccattctggcttccaaaaggggcaacaatccgacgcacgatcgaacgttatatcgtagacaaagaagttagtctaggttaccaacatgtatatacaccaataatgggagatgttgagttgtacaaaacatctggacactgggatcattatcaagaagacatgttcccgccaatggatatgggagatggcgaaatgcttgttcttcgcccaatgaactgccctcatcacatgatggtctacaaaaacacgatccattcttatcgtgaattaccaattcgtatcgctgaattaggaatgatgcatcgctatgaaaaatcaggtgctttgtcaggtttacaacgtgtacgagaaatgacgttgaatgatggtcatacatttgttcgtcctgatcaaatcaaagatgaatttaaacgtacgcttgaattgatggtggcagtatatgctgacttcaatattacagattatcgtttccgcttgagctatcgcgatccaaacaatacagataaatattttgatgatgacgcaatgtgggaaaaagcccaagcaatgctgaaagccgctatggatgaattagaactagattactttgaagcagaaggcgaggcagccttttacggaccaaaactagatgttcaagtcaaaacagctcttggtacagaagaaacattatcaactatacaattagacttcttattgccagagcgctttgatttgacatatgttggagaagacggggaaaatacgcatcgtccagtagttatccaccgcggaattgtttctacaatggaacgttttgtcgcttatttaacagaagtatacaaaggcgcttttccaacatggttggcacctatacaagcaacaatcatccctgtttctgttgatgcacatggcgattatgcttatgaaatcaaagaacgtttgcaaatgaaggggttgcgtgtagaagttgatgatcgtaatgaaaaaatgggctataagatacgtgcctctcaaacacaaaagatcccttaccaattagttgttggagacaaggaattggaagatgcaacagtgaacgtacgtcgttatggaagtaaagaaacagctgtagaagatttgaatatctttattgatgctatggaagcagaagtcaaaaattacagcagagaaaactaa

SEQ ID NO: 354 - DNA, 984 bp, Enterococcus faecium
atgactactaatttttggaaagagctgccaaagcctttttttgttttagcaccaatggaagatgtaacagatgttgtatttcgccatgtcgtaaagcatgcagcagcaccggatgtcttctttactgagtttacaaactcagacagtttctgtcatccagatggaaaagacagtgtacgaggaagattaacatttacagaagatgaacagccgatggttgcccatatttggggagacaagccagaattttttagagaaatgagcattgctatggcagaaatgggcttccaaggaatcgatatcaacatgggctgcccagtccctaatgtagcagaacgtggaaaaggcagtggcttgatccttcgtccagaagtagcggcacaattgattgaagcagctaaagctggcggtttgcctgtcagcgtcaagacgcgtatcggctatacggaaatgtctgagatggaagaatggatcagtcacctacttcatcaagatatagccaatctttctgtccatttgcgtacgcgtaaagagatgagtaaagtagatgcacattgggaagtcattcctaaaatcattgctttacgtgaccaaatcgctccacaaacactaatcacgatcaatggagatatccccgatcgccagacaggagaagaattggccgagaaatatggcgttgatggcatcatgattggccgagggattttcaagaatccttatgcatttgaaaaagacccgagggaacatacagaaaaagaactgatcggactacttcgtctgcaactagatctgcaagatcattattcagaaatcatcccgcgttccatcacaggactacatcgtttctttaaaatctatatcaaaggatttccaggagcaaatgacttgcgagttcagttgatgaatacgaaatctactgatgaagtacgagagatcttagagacctttgaaaaagaacatccaacgcttttcagtgaacaatga

SEQ ID NO: 355 - DNA, 1254 bp, Enterococcus faecium
gtggtgaaaaagtcattcaaaccgtttggggagtgggctataaaattgacgcaagatagtaaacgagcaactgaaaaacgccgtcggatcaatttgacttcaaaagaaatcagcgaattgttagcggaaggaatcatcacgattatccttttgcttctattaaatgtttctattctggttgttatcagttcggtgatcaacagttcaccttctttgacgaatgcgatttgggattcaaagaatatttttgcagaacgattgaacactgatttgttctggaacggccggaattttattattccctttttctttctattagatattggtgttttgtattggcgcttgattcgaagatatcgccaaatgcaattgcggcatatcatcagcgaacttcactacatcgcaaacggaaattatgatcatcgtatcccttttgaactgagtggtgacttaagccgagtggtaacaagtatcaatggattggtggatagtaccgtagcagcgattgaagacgaacgtaaaatcgaaaaatcaaaagatgaattgatcacgaatgtcagtcatgatatccgtaccccactcacgtccatcattggatacctaggactgatagaagatggccagtatcactcagaagaagatcttttaaagtatacgcatactgcttatatcaaagcaaagcagatgaaatctttagtggacgacttatttgaatacactaaggtacgccagcctgctgtcccggtgaatttttctgcctttgacatgatccagttgatcgaacagttagcagctgattttgagttggaagcttctaaaaaaaatatccaaatacttgttcaatcaaaagtagactcccttatcatggatggcgataccgaaaaacttgtacgtgtcttcaataatcttttgacgaatgcgttgaaatacggaaaaggagcaacgaagatcgtaatcgaagtagaacgtatcggttcagaagttgttgcaacagtcaaaaataacggagcaatgatcccacaacaggcaatcgataatctattcgaccgtttttatcgtgtagaagaatctcgttcacaagcaactggaggaactggacttggtttagcaatcgctcaaagcattgtggctttgcacggcggatacatttatgcaaaatcagataagcaatggacttctttcatcatgcaccttccaatcaagaaaaatgaaaaattacctattgatacacaggaagttattgacgaaagctga

SEQ ID NO: 356 - DNA, 681 bp, Enterococcus faecium
atgaatcattttaaaggcaaacaattcaaaaaagacgtcattattgtcgctgttggttactacctgcgttacaatctaagctatcgtgaagttcaggaattgttatatgatcgtggaataaatgtttgtcatactacgatttatcgttgggtacaagagtacagcaaagtcctctattatctttggaagaagaaaaatagacaatccttctattcatggaaaatggacgaaacctatatcaaaattaagggacgttggcattatctttatcgtgcaattgatgcggacggcttaaccttagatatctggttacgaaagaaacgggatacgcaagcagcctatgatttcttaaaacgactccataaacagtttggtgagccgaaagcaattgtgaccgataaagcaccttctcttggctccgcctttagaaagttacagagtgtgggtttatatactaagacagagcaccgaactgtgaagtatcttaacaatttaatagaacaagaccatcgacctattaaacgacgaaataaattttatcaaagtctccgtacagcctcttccacgattaagggcatggagaccattcgaggaatatataaaaagaaccgaagaaatggaacgctcttcggcttttcggtgtctactgaaatcaaggtattaatgggaataacagcctaa

SEQ ID NO: 357 - protein, 329 aa, Enterococcus faecium
MVGIILASHGQFAEGILQSGSMIFGEQENVKAVILKPSEGPDDLRAKLEEAVASFDNQDEVLFLVDLWGGTPFNQSNTLFEEHKDKWAIVSGLNLPMLIEAYASRFSMESAHEIAAHIIETAKDGVKVKPEELEPAEAPKAAVEDAQPKGALPEGTVVGDGKIKYVLARVDSRLLHGQVATAWTKAVQPNRIIVVSDAVSKDDLRKRLIEQAAPPGVKANVIPISKMIEVAKDPRFGNTKALLLFENPEDVLTAVEGGVDIKELNVGSMAHSVGKVVVSKVLSMGQEDVEAFEKLEQKGVKFDVRKVPNDSRDNMDDILKKAKAELAKA

SEQ ID NO: 358 - protein, 368 aa, Enterococcus faecium
MIIKEEIFVPKELVKEKIDLLVENLTTIKDDNGEFLLDFDGLKVDDKSWTVWNWPQGVGLYGIYKNYQMTKNPRAYQVVNEWFEDRMEEGAPPKNVNTMAPLLTMAYLYEDTKDSRYLPYLEQWAEWVMNDMPRTNEDGLQHATYGPENKNQLWDDTLMMTVLPLAKIGKLLNRPEYLEEARYQFMIHIKYLMDKRTGLWYHGWTFEGNHNYAEAFWARGNCWLTIAIPEIIEILELSKEDALRKLLIETLEAQVRALKTYQSESGLWHTLLDDPSSYVESSATAGFAYGILKAVHKRYLPQEYKEVAYRAIQGLLEQIDEKGEVQNVSIGTGMGDSLDFYRNIGITAMPYGQSLTVLCLTELLVSYC

SEQ ID NO: 359 - protein, 312 aa, Enterococcus faecium
MKIAIAGAGAMGSRFGLMLHQSGNEVLLIDGWAEHVQQIKEHGLQANFNGKEVEAKLPIVLQSEVEKEDQVDLIILFTKAMQLEKMLQDIQSLIKKDTEVLCLLNGIGHEDIIEKFVPMENIYIGNTMWTAGLEGPGQVKLFGSGSVELQNLGDGKEAAAKKLADKLSESGLNAHFSDNIHYSIYRKACVNGTMNGLCTILDVNMAELGKTSTAHKMVATIVNEFAKVAAVEKIELDVPEVIAHCESCFDPETIGLHYPSMYQDLIKNHRLTEIDYINGAISRKGKKYGVATPYCDFLTELVHAKEDSLNVK

SEQ ID NO: 360 - protein, 318 aa, Enterococcus faecium
MTFPYSEGNKRYHSWNYALRNEFGGKIFKVPIDGGFDCPNRDGTVAHGGCTFCSVSGSGDMIVAPEDPLPIQFQKEIDMMHQKWPHVQQYIVYFQNFTNTHAPVEIIKERFEQVVNLPGVVGLSVGTRPDCLPDEVVDYLAELNERMYLWVELGLQTTFEETSKLINRAHDYQTYLDGVAKLRKHNIRVCTHLINGLPGESLEMMKENVRRTILDSDIQGIKLHLMHLMRKTRMLRDYHEGRLQLMSRPDYVNVICDQLEMIPKEIIIHRLTGDAPWDSLIGPMWSLKKWEVLNAIDEELLRRDSFQGKYDVRKKVSV

SEQ ID NO: 361 - protein, 441 aa, Enterococcus faecium
MAKTGMYVGLDIGTTSVKVVVAEYIDSQMNIIGVGNAKSEGINRGIIVDIDKTVQAIQRAVRQAEEKAGIQIKGVSVGLPANMLEVENCQGMIAVNGDSKEITDEDVRNVASAALVRSIPPERQIVSILPQDFTVDGFEGIKDPRGMIGVRLEMYGLLFTGPKTIIHNIRKCVENAGLIVNEMVITPLALTESILSDGEKDFGTIVIDMGGGQTTTAVMHDKQLKFTNLDQEGGEFVTKDISIVLNTSFNNAEALKINYGDAYPERTSPDEEFPVDVIGQSEPVKVDERYLSEIISARMEQIFNKAKDALDQIEALELPGGVVLTGGAASLPGVVDLAQEIFGVNVKLYVPNHMGLRNPVFTNVISIVDYSANLSEVYQLAKIAVTGETSAARQMVVEQETTNTYESYEAPEETIYDEPEPKESGENVKNKIKGFFTNIFD

SEQ ID NO: 362 - protein, 105 aa, Enterococcus faecium
MAKKTIMLVCSAGMSTSLLVTKMQKAAEEKGMEADIFAVSASDADNNLESKNVDVLLLGPQVRFMKAQFEQKLAPKGIPLDVINMQDYGMMNGEKVLAQAENLMK

SEQ ID NO: 363 - protein, 625 aa, Enterococcus faecium
MKNHKKINVMLGVLFLILPLLTNSFGAKKVFAEETAAQVILHKKKMTDLPDPLIQNSGKEMSEFDQYQGLADISFSVYNVTQEFYAQRDKGASVDAAKQAVQSLTPGTPVASGTTDADGNVTLSLPKKQNGKDAVYTIKEEPKDGVSAAANMVLAFPVYEMIKQADGSYKYGTEELDTIHLYPKNTVGNDGTLKVTKIGTAENEALNGAEFIISKEEGTPSVKKYIQSVTDGLYTWTTDQTKAKHFITGHSYDIGNNDFAEASIEKGQLIVNHLEVGKYNLEEVKAPDNAEMIEKQTITPFEILANSQTPVEKTIKNDTSKVDKTTPQLNGKDVAIGEKIQYEISVNIPLGIADKEGTQNKYTTFKLIDTHDAALTFDNDSSGTYAYALYDGNKEIDPVNYSVTEQTDGFTVSVDPNYIPSLTPGGTLKFVYYMHLNEKADPTKGFSNQANVDNGHTNDQTPPSVDVVTGGKRFVKVDGDVTSDQTLAGAEFVVRDQDSDTAKYLSIDPSTKAVSWVSAKESATVFTTTSNGLIDVTGLKYGTYYLEETKAPEKYVPLTNRVAFTIDEQSYVTAGQLISPEKIPNKHKGTLPSTGGKGIYVYIGAGVVLLLIAGLYFARRKHSQI

SEQ ID NO: 364 - protein, 786 aa, Enterococcus faecium
MNNRILETLEFEKVKQMVRQFVVTAQGKEELAELVPVSEKQTITNWLQETEDGLKVQRLRGGIPIPKLENIRPHMKRIEIGADLNGVELAQVSRVLSTTSELNRFIDDLSDSEIEFARLYMWADQLVTIPVLSRRLKEAIDEDGRVTDDASPELKSIRQNIRRSEQAVREQLDGIVRGKNAKYLSDAIITMRNDRYVIPVKQEYRGVFGGVVHDQSASGQTLFIEPKQVVDLNNRLRQYQIAERNEIQRILSELSAELVPHRQEIIHNAYVIGKMDLMNAKARFGKEVKAIVPGISEDNHVVLKQARHPLIDQEKVVSNDITIGKDYQAIVITGPNTGGKTITLKTLGLLQLMGQAGLPIPAGEESQIGIFEEVFADIGDEQSIEQSLSTFSSHMTNTVDILSKVNEKSLVLFDELGAGTDPQEGAALAIAILDDLGKKSAYVMATTHYPELKVYGYNRANTINASMEFDVDTLSPTYRLLIGVPGRSNAFEISSRLGLDTEVIDEAKQLMNDESQDLNEMITDLENRRKMAETEYLEMRHFVSEAQELHDDLKEAYSYFFEEREKEMEKAKKKANEVVSEAEEKAEKIIADIRKMQQQIGQGNVKEHQLIDAKTQLANLHQEETLKKNKVLKKAKEQKTLKPGDEVLVTTYGQRGTLLRKNGNQWQVEIGILKMNVSEDELTPVAPQKEPTQRVIHAVRSESSSHVPNQLDLRGKRYEEALSEVDQYLDSAILAGYPQVTIVHGKGTGALRKGITDYLKNHRSVKSFEFAPANQGGNGATIVKFK

SEQ ID NO: 365 - protein, 317 aa, Enterococcus faecium
MFDGYCSRVVNGNPNVKPATRKKVLEVIDRLDYRPNAVARGLASKKTTTVGVIIPDVSNMFFASLARGIDDVATMYKYNIILANSDGNDQKEVNVLNNLLAKQVDGVIFMGHHITDEIRGEFSRSKTPVVLAGSIDPDEQVGSVNIDYVSATKDAVNKLAKSGNKKIAFVSGALIDPINGQNRLKGYKEALSENNLPYSEGLIFEAQYNFKDGLSLADRIHNSGATAVYVSDDELAIGILDGLLDRGVKVPEGFEIITSNNSLLTEVARPRLTSITQPLYDLGAVSMRLLTKMMNKEEVEEKTIILPYGIEEKGSTK

SEQ ID NO: 366 - protein, 214 aa, Enterococcus faecium
MKKIDILSRLKNAGVIAVVRGKSKEEALNACHAIIKGGLTGIELTFTVPQADQVIKELLSFYKDQPEIVIGAGTVLDAVTARLAILAGAEYIVSPSFDQETAEMCNLYQIPYLPGCMTITEIKTALKSGVDIVKLFPGSAYGPSIISAFKAPMPQVNIMPTGGVSLDNMKEWFDAGVVTVGVGGNLLAPAATGDFDKVTEVAQQYAAKMKEIKR

SEQ ID NO: 367 - protein, 1421 aa, Enterococcus faecium
MDSVVVHRKSRLWEFTLHFSKILPIMLYRSLTQHLTIAFKDIAQVKLNILADDQTFDEQLLQDYWAQALENQQCDTPLAQQVLKTQVPVIKDRKVILPIDSTGAISYLKQQYLPLVEELFVSYGFPKFRIEPEVDEQQAERVLKLFEERKQEQAEAFMKQAAESLVVHEQKKKERKEQSPALEGPIHIQLGRNIPADEPTTPMISIVEEERRVTLEGYVFDKEVRELRSKRKILTLKITDYTSSFIVKKFSNGEKDEQVFDAISVGSWLKVRGSIQEDTFVRDLVMNAQDIIEVKHTPRKDYAPEGEKRVELHVHSNMSTMDATNSISDLVAQAGKWGHRAIAITDHGGAQAFPEAHSAGKKAGVKILYGVEANVVDDGVPIAYNDAHEALSEATYVVFDVETTGLSAVYDTIIELAAVKMYKGNVIESFDEFIDPGHPLSRTTVDLTGITDGMVRGSKSEEEVLRMFLEFSKDTILVAHNAAFDMGFLNTSYARYGIPEAANPVIDTLELARYLYPQFKRFGLGVLSKKFGVSLEQHHRAIYDAEATGHLAWIFVKEAMDNHNMLYHDQLNEHIGEGDSYKRARPFHVTILAKNQAGLKDLFKLISMSNVEYFERVPRIPRSQLKKMRENLLIGSACDKGEIFEAMMQKGVEEARNRAKFYDYIEVMPKAVYAPLIEQELVKNEHDLEEIIQNLVEIGKSLDKIVVATGNVHYLNEEDAIYRKILINSMGGANPLNRHSLPDVHFRTTDEMLTAFHFLGEETAKEIVVENTNKIADICEEVIPVKDELYTPKIPGSEDEISELSYTKAKQMYGDPLPEIIQKRLKKELNSINGNGFSVIYLIAQKLVHKSNEDGYLVGSRGSVGSSFVATMTGITEVNPLAPHYYCPECQYSEFFEDGTYGSGFDMPEKQCPKCGARLNKDGHDIPFETFLGFHGDKVPDIDLNFSGDYQAEAHNYTKVLFGEDYVYRAGTIGTVADKTAYGYVKGYERDNNLQFRSAEVDRLAKGATGVKRTTGQHPGGIIVIPDYMDVYDFTPIQYPADDQNSEWKTTHFDFHSIHDNVLKLDILGHDDPTVIRMLQDLSGIDPQTIPTDDPEVMRIFAGPEVLGVSQEQIYSKTGTLGIPEFGTRFVRGMLEETHPTTFAELLQISGLSHGTDVWLGNAEELIRRGDATLAEVIGCRDDIMVYLIHAGLDSGMAFKIMETVRKGQWNKIPDELRETYLSAMKENNVPDWYIDSCSKIKYMFPKAHAAAYVLMALRVAYFKVYFPILYYCAYFSVRADDFDLVSMCKGKDAVKQAMKEITDKGLDASVKEKNQLTVLELANEMLERGFKFGMIDLYKSDAVNFVIEGDTLIAPFRAVPSLGTNVAKQIVEARKDGPFLSKEDLATRGKVSKTLIEYMNDNGVLKDLPDENQLSLFDML

SEQ ID NO: 368 - protein, 131 aa, Enterococcus faecium
MVLWVINIILLLIVLAIILWEVYLRVMAKRSATTLTEEEFREGMRKAQVIDVREKDVFDAGHILGARNIPYTVLKDSLGSIRKDQPVYIYDQKKSLSIRTANKLRKAGYQEIYLLKGGYDGWSGKIKSKKV

SEQ ID NO: 369 - protein, 646 aa, Enterococcus faecium
MIKITFPDGAVKEFESGTTTLAIAESISKSLAKKALAGKVNGKLVDLTRPIEEDASIEIITPDHEDALGLVRHSAAHLMAQAMRRLYPNIHFGVGPAIDSGFYYDTDNGQNQVTAEDLPAIEAEMMKIVKENLPIERRVLSKQEALEIFASDPYKVELISELPEEEVITAYQQGEFIDLCRGPHVPSTGRIQVFKLLSVAGAYWRGNSNNQMMQRVYGTAFFDKKALKEYIRLREEAKERDHRKLGKELDLFMVSPEVGSGLPFWLPKGATIRRTIERYIVDKEVSLGYQHVYTPIMGDVELYKTSGHWDHYQEDMFPPMDMGDGEMLVLRPMNCPHHMMVYKNTIHSYRELPIRIAELGMMHRYEKSGALSGLQRVREMTLNDGHTFVRPDQIKDEFKRTLELMVAVYADFNITDYRFRLSYRDPNNTDKYFDDDAMWEKAQAMLKAAMDELELDYFEAEGEAAFYGPKLDVQVKTALGTEETLSTIQLDFLLPERFDLTYVGEDGENTHRPVVIHRGIVSTMERFVAYLTEVYKGAFPTWLAPIQATIIPVSVDAHGDYAYEIKERLQMKGLRVEVDDRNEKMGYKIRASQTQKIPYQLVVGDKELEDATVNVRRYGSKETAVEDLNIFIDAMEAEVKNYSREN

SEQ ID NO: 370 - protein, 327 aa, Enterococcus faecium
MTTNFWKELPKPFFVLAPMEDVTDVVFRHVVKHAAAPDVFFTEFTNSDSFCHPDGKDSVRGRLTFTEDEQPMVAHIWGDKPEFFREMSIAMAEMGFQGIDINMGCPVPNVAERGKGSGLILRPEVAAQLIEAAKAGGLPVSVKTRIGYTEMSEMEEWISHLLHQDIANLSVHLRTRKEMSKVDAHWEVIPKIIALRDQIAPQTLITINGDIPDRQTGEELAEKYGVDGIMIGRGIFKNPYAFEKDPREHTEKELIGLLRLQLDLQDHYSEIIPRSITGLHRFFKIYIKGFPGANDLRVQLMNTKSTDEVREILETFEKEHPTLFSEQ

SEQ ID NO: 371 - protein, 417 aa, Enterococcus faecium
VVKKSFKPFGEWAIKLTQDSKRATEKRRRINLTSKEISELLAEGIITIILLLLLNVSILVVISSVINSSPSLTNAIWDSKNIFAERLNTDLFWNGRNFIIPFFFLLDIGVLYWRLIRRYRQMQLRHIISELHYIANGNYDHRIPFELSGDLSRVVTSINGLVDSTVAAIEDERKIEKSKDELITNVSHDIRTPLTSIIGYLGLIEDGQYHSEEDLLKYTHTAYIKAKQMKSLVDDLFEYTKVRQPAVPVNFSAFDMIQLIEQLAADFELEASKKNIQILVQSKVDSLIMDGDTEKLVRVFNNLLTNALKYGKGATKIVIEVERIGSEVVATVKNNGAMIPQQAIDNLFDRFYRVEESRSQATGGTGLGLAIAQSIVALHGGYIYAKSDKQWTSFIMHLPIKKNEKLPIDTQEVIDES

SEQ ID NO: 372 - protein, 226 aa, Enterococcus faecium
MNHFKGKQFKKDVIIVAVGYYLRYNLSYREVQELLYDRGINVCHTTIYRWVQEYSKVLYYLWKKKNRQSFYSWKMDETYIKIKGRWHYLYRAIDADGLTLDIWLRKKRDTQAAYDFLKRLHKQFGEPKAIVTDKAPSLGSAFRKLQSVGLYTKTEHRTVKYLNNLIEQDHRPIKRRNKFYQSLRTASSTIKGMETIRGIYKKNRRNGTLFGFSVSTEIKVLMGITA

SEQ ID NO: 373 - DNA, 564 bp, Enterococcus faecalis
atgattaataacgttgtattagtcggaagattgacaaaagatcctgacttacgttacaccgctagtggttcagctgttgcgacctttacacttgctgtaaaccgtaactttacgaatcaaaatggtgatcgtgaagcagactttatcaactgtgtgatttggcgtaaacccgcagaaacaatggctaattatgcccgtaaaggtacattattaggtgttgtcggaagaattcaaactcgtaactacgagaaccaacaaggtcaacgtgtctacgtaactgaagtggtttgtgaaaacttccaattgttagaatctcgttctgcttcagaacaaagaggaactggcggcggtagctttaataacaacgaaaatggttatcaatcacaaaatcgtagctttggtaataacaatgccagttctggatttaataacaacaacaatagtttcaatccatcatcttctcagtcgcaaaacaataacggtatgcctgatttcgataaagattctgatccatttggtggctcaggttcatctatcgacatttcagatgatgatttaccattc

SEQ ID NO: 374 - DNA, 1566 bp, Enterococcus faecalis
atggcagtaaagaaaaagaaagcgactttctgggagtttttccaaggattaggtaaaacgtttatgttgccagtggctttattagcttttatggggattttgttgggattaggaagttctttttccagtgaatccatgattgaaacgatcccgtttttaggaaagcccgcagtgaaaattattttccaatttatgtcgacaattggtggttttgcgtttgcctatttacctgtcatgtttgcaatggccattccgttggggttagttcggaaagaaaaaggaattgctgcgttttcaggtttcgtaggctatacggtgatgaatttagcgattaatttctatttagtgcagacgaatcgcctcgtggatcctgagcagttgcgggaagccggccaaggaatggtttttgggattcaaacgattgaaatgggtgttcttggtggaattatcgctgggcttattgtctataagttgcataatcgattttatacggtgcaactaccagatagttttgccttcttttctggcgcacggtttgtgccaattattacttcattagtaatggcattcgtgggcttagtaattccgttagtttggccacttttcgcgctaatgattatggcgattggccaacttatccaacgttctggtatttttgggccttttctgtttggttcaggggaacgtctactgttaccgtttgggttgcatcatattttggtttccatgattcgttttactgaagcagggggttcagcggtggtggctggcaaagaagtgtttggcgcgttaaatattttctatgcagaattgcaaaataatttaccgatttcaccaagcgcaacagctttcttgtcacaagggaaaatgccgacctttatttttggcttaccagcggcgtcacttgcgatgtatcatactgcagctccggcgaatcgacataagattaaaggcttactcctttcgggtgtaattgctacggctatcactggcattacagaaccaattgaatttttattcttatttattagtccattattatggctgtttcatgtcattatgactggtctaggtttcatggtaatggctttattaggtgttgtgattgggaacactgatggcgggctactggactttgttatttttggcttgttacaaggaacttatacaaaatggtggtgggttctcattgtcggcgctatctggtttgttgtttattatttcgtctttaaaacagtcattgtaacctttgatttaaaaacacctggacgagacaaggtcttagatgagactgaatataccgatcaagaagttcaatataagaaaacgggtggctatgatgcgcctgggattttagcggctttgggtgggcaagagaatattcaagctattgataattgcattacgcgtttacgtttagtgttagcagatgctaataaagtagatgatgacaaattaaagcaattaggggctttaggcgttgtacatttagatgcgcagaatgtacaagtgattatcggaaccaaagtgacaacggtccgtaatcaattagagatgattttaggt

SEQ ID NO: 375 - DNA, 2703 bp, Enterococcus faecalis
atgaaaaagatcgcaagtgcagggttaagtattttagtcgcaacgggggtagcaggtattgggggaaatgaagtacaggcagcagaacaagcgcaaccaaaaacacctgaaaacagttctacagaacaaccagcagtgaaagctacagaaacaacggagcaagccattactgaaaaacagcaacaagtaacagagaaacaagcaattgtcgatcaaaaacaacaagttgctgacactgcgaaaaaagaaaaagacaccattgatcaatctgttaaagaccaacaagcagtggtcgatcaaaacaaaggtgcattggatcaaagtcaacaagcagtgactgaccaacaagcggtcgtagacgaagcaaaaaaagttgtggatgaagcaacaccttcagccattgaaaaagccaaaaaccaagtggctacggatacacaagctgttgatgaccaacaaaaagtagtggatcaagctcaagcagacgttaaccaacaacaagcagttgtcgaagaaaaagcaaaagaaacgaatgctgctaaagtgcaaaatgataaagatcaacaagcagtaacagctgcgaaacaagaacaagccaagcttgaagaattagcgaaaaatgcggaagtggaaaaagcaaaggctgaaaaagaacaagcagcaaaagaagctgaactggctaacaaacagaaagaagaagccaaagctaaagatcaaaaaacgaaggacgatcaagcagtcgcagaccaacaaactgttgtgacaactagtcaagagaaagtagcagacgcaaaagcagatacagctgcgaaacaggcagacttaacagcgaaagagaatgctttgaaagacaagcaaacagcaacaaagcaagtgcagaatactttagataaatcaaaagaagagctaaaaggacataaaggaattaacttgcctgctaacttcacacctgattattacaaaaaattatctgaacaagaaaagcaagcaatggaaaaagaagcattagcattaaataaagtttttcctgaaaatcaagcagatgtggcaaaagcaacggaaatgatcaatgtcaaaaatcctaccggaaaacaaaagcaacaaatgagcgattacgttgtaggacttatcaatgatgttcgcgaaaagcttgggttacaaaagttgaagatttctaaccaagctatgagatttgcttgggatgtagcaaaatatgataatcccaaagagtttgatcatgacgtaaatgcaattaatcgtgcagcaaaagaaaatggttttaaagagtatccagggcaaaacttttatgaaaatctaagtatgggctattttgaaacgattaatggcactatttctcaactagagtttgaaaaagctgctcgaaaaacaattgctgatatgctctttgacgatgaaagttcagcgtattctcatatagattcattgctaaaaggggacacaacaaacatggcagtttctatttcaggagatttaaatgatatttcggcaaaaatccatatcattagctataatcaatcaaaattagttgaagcaaatacctatgaagaaggcactgctccagtctttaagagtaaagaaacccttcaaaaagaagtagcaaccaatcaagaaaaattagctactgcacaacaagcagaatcagacgctcaacaagcaaaaagtgcaagtcagcaagtcttaaatacagccaaaacaacacaagcaacagcagaaaaagaactatctgttcataaagcgacattggctagtcttcaagcagttgcgactaaaagtacgacaaattatgaagaaaaagtacgacaaactgcaacggcagaaaaaagccttcaacaaacaaaagatcaattggcaacaatcaatgagttaattcagaatcgagctgctgttttagaaaaagcgaaaacaaacgtttcggaagcacaagcaattgaacaaacgtctgctaaagtgctgaaagaaaaacaagcagcccaaaaagcagaagaaaacacattgaatagcttgaaggaagtattgaatttagcaaaagaaaatttaaatcaaaaacaagttgcatttaaaacaagtacacgttcattgtctcgtttagaaaatgctcaaccaacatacgaaaaagcattaaacgagttaaacaaagcagaagcagcagcggtccaagcacaagaagcctatgaaaattctctgaaatcattggaggaacttaaagaacaacaagccgttgctacacttgcttatacacaagcacaagaagacctttctaacgcgaagttagagctacagcagtaccagggcgtattaagagaattagaagcacaacaagccgaacagcagcgacaagaagcgttgcaagaacaagtagcaaaagaacaacaacgccttgaacgagaagcaaaacaaagccaaacgttagtagcaagtgctacttcagcagacaaaacacctggtctccaacagttatctttttctaaacaaaaagaacagccaaaagcacaagcattaacacattcagaatctcgtaagacgaaacaagtagcaaaagccccagattctttaccacatacaggagaaaaaaataataaatggttagctatagctggtctgatatttgctttgttaggagctgcgggtattataagttttattagtagaaacgagaagaaagtaaaaaatatctttaaaattaaa

SEQ ID NO: 376 - DNA, 846 bp, Enterococcus faecalis
atgaaaaaaatgattattattgccttattcagtacaagccttttagcagggggaagcagtgtttctgcttatgcgcaagaatcagaaggaaatcttggtgaaacaacagggagtgttttaccagatgaaccgaatgtaccaactgacccaataacgccaagtgagccagagcaaccaacagagccaagtacaccagagcaaccatcggaaccgtcaacaccaaccgaacctagtgagccttcaaaaccgacggatccttcgttaccagacgaaccgagcgtaccaacagagccaacaacgccaagtaagccagagcaaccaacagagccaacaacgccaagtgtaccagagcaaccaacagagccaagtgtaccagaaaaaccagtagaaccaaataaaccaaccgagccagaaaagcctgtgccagttgttcctgaaaaaccagttgtaccacaacaaccagagcaaccaacagatgtggtggtaaagccaaatggagaaattgcaacaggagaatctacacaacagccaactgttccaattgaaacgaataacctttcagaagtaacacatgtcccaactgtgacgacaccgattgaaacagcaagcggagaagcaattgtcgcagtggataagggcgttcctttaacacaaacggctgatggattaaaaccgattaaaagtgaatataaagtattaccaagtggcaatgtacaagtgaaaagtgctgacggaaaaatgaaagtacttccttacactggtgaaaaaatgggcataattgggtcaatcgctggtgtatgtttgactgttttatcaggaatcttaatttataaaaaacgtaaagtg

SEQ ID NO: 377 - DNA, 1347 bp, Enterococcus faecalis
gtgaagaaacgtctatttgcatcagtattactatgttcattaacgctatcagcaattgctaccccaagcatcgctttggcggacaatgttgataaaaaaattgaagaaaaaaatcaagaaatttcatcattaaaagcaaaacaaggggatttagcttcacaagtatcttctttagaagcagaagtatcttcagtatttgatgaaagcatggctttacgtgaacaaaagcaaacactaaaagcaaaatcagaacaattacaacaagaaattacaaacttgaatcaacgtattgaaaaacgtaacgaagcaatcaaaaatcaagcacgtgatgttcaagttaatggacaaagcacaacaatgctagatgcagttttagatgcggactcagttgcagatgcaatcagccgtgttcaagctgtttcaacaatcgtaagtgccaacaacgacttaatgcaacaacaaaaagaagacaaacaagccgttgttgataaaaaagctgaaaacgagaaaaaagtgaaacaacttgaagcaacagaagctgaattagaaacaaaacgtcaagatttactttctaaacaatctgaattaaacgtaatgaaagcttcattagcattagaacaatcatcagctgaaagttctaaagctggcttagaaaaacaaaaagcagctgctgaagcagagcaagcacgcttagctgctgaacaaaaagctgcagctgaaaaagccaaacaagctgctgcaaaaccagctaaagctgaagtgaaagcagaagcaccagttgcctcttcatcaacaacagaagcacaagcaccagcaagctcaagctcagcaactgaatcaagcacgcaacaaacaactgaaacaactacaccaagtacagataatagtgcaacagaaaatactggctcttcttcatcagaacaaccagtacaacctacaacaccaagcgataatggaaataatggtggccaaactggtggtggaacagttacaccaacaccagaaccaacaccagcgccttctgctgatccaacaatcaatgcattgaacgttctacgtcaatcattaggtttacgtccagtagtatgggatgcaggtttggcagcttctgcaactgctcgtgcagcacaagttgaagcaggtggcattccaaatgatcactggtctcgtggagatgaagttatcgcaattatgtgggcgccaggtaactcagtaatcatggcgtggtacaatgaaacaaacatggtaacagcttcaggaagcggtcaccgtgattgggaaattaacccaggtattacgcgtgtcggttttggttactcaggtagcacaatcgtaggacactcagcc

SEQ ID NO: 378 - DNA, 597 bp, Enterococcus faecalis
atgaaatcaatcaaaacgattttacttggaacaactttggccgcaggtttaggattattcttaggaacagacgcaaacgcagaaagcttatatacagttaaagcaggagatactttatcaacaatttctcatcaatttgcaggagacaatagcttaattcaaaaaattgcttctgataacaaattgccaaaccttgatttaatttttgaaggagaacaattagttattcgttcagaaaaagaagttgctaatactccagcaccagctgtagaagttgcaccagttcaacaagtagttgaacaacctgttgcacaaccagtacaacaagaagtacaacaacctgttgctcaagaagtagcgcaaccagcagcacctgctgcaagcagtgatgcaaaagagtggatcgcacaacgtgaatctagtggttcttacgatgcaacaaacggtcagtatatcggtcgttaccaattatctgcctcttatttaaatggtgactattcacctgccaaccaagaacgcgtggcagatcagtacgtagcaggtcgctatggttcatgggatgcagctaaatcattctggttagcaaatggttggtac

SEQ ID NO: 379 - DNA, 2028 bp, Enterococcus faecalis
atgaaaaaaatctatcaatgggcagtgggacaatcctttaaaaaattggatccacgccaacaagttaaaaatcccgtgatgtttgtcgtttatttaggtgcgctcatcactacaatattatgcttctacccaatgggtataccgttatggtttaacatttcaataaccatttttctttggttgactttgctttttgcgaattttgctgaagctgttgcagaaggacgaggaaaagcacaggccgatagtttgaaacaagcaaaaaaggaagtcatgacttataaaattaacagtttagaagatatcaaagaagagaatttcattgaattacagtcttctgatttaaagcgaaacgatttggtctatgtacgtgcaggagagcaaatcccagctgatggtgatgtaatcgagggggctgcatcagtagatgaaagtgccattactggcgaatcagcgccagtaattcgtgaatctggtggggatcgcagtgcggttactggcggaacaaccgtcgtttccgattatttagtgattcgtgttacctcggaaaacggtcaatccttcttagataaaatgattgccatggtagagggaactcaacgaaaaaagactccgaatgagattggtttgcagattttcttgattactttgaccattattttcttaactgtatcaattactttagtcccatttactgatttcagcagtcagttatctggtaaaggagaagctttatcactggttattgtgattgctttactaatctgtctggcgccaacgacgattggggccttaatctcttcgatcgggattgcaggtatgagccgcttgacgaaggaaaacgtcattgccatgagtggtcgtgcgatcgaagcagctggtgacgtggatgttcttttactcgacaaaacaggaaccataacattgggaaatcgacgagcaagcgattttttgccagtccatggtgttagtgaagaacagttagcggatgcggcgcaattatcttctttagctgatgagacagcagaaggtcgaagtatcgtgattttagcaaaagaacgtttcaacttgcgggaaagagaattccagcaatcagaggttaaatttatcgatttcagtgccaaaacacgcatgagcggaattgattatcgcggtgacgtgattcgcaaaggtgccgcagacaccatgaaaaaatatgtacaatctaaaggagaggactatccatctgaatgtgacaagattgttgataaaatcgctcgagcaggtggaacacctctagtagttataaaaaataatcgtgtgatgggtgtcgtctatttgaaagacatcgttaagaatggtgtaaaggaaaaatttgctgatatgcgtaagatgggtatcaagaccatcatgatcactggggataaccccttaacagcggcagcgatagcagcggaagctggagtagatgatttcttggcagaagctaccccagaaaataaaatgaatctgattcgcgagtatcaagaaaagggtcacttagttgcaatgactggtgatgggacaaacgatgcaccagcattagcgcaagccgacgttgcgatggcgatgaatacaggaacacaagccgcgaaggaagcggggaacatgattgatttggattccagtccaacaaaattgctgcaagtcgtacagattgggaaacaattgttgatgactcgcggcgcgttaactacgtttagtatcgcaaatgatatcgctaagtattttgcggtgattccagtactattttacagtatttatccgcaactggatcgattgaatattatgggattaggtagtccactgactgcgattctatccgctgtcatttataatgcagtcgttatcgtggccttgattccactagcattaaaaggtgtgaggtatcaagaaaaaccggccagtcaaattttgagtcataatctgctgatttatggacttgggggaattattgcaccatttatttttatcaagattatagatctgattctctcgctgatcatttta

SEQ ID NO: 380 - DNA, 4707 bp, Enterococcus faecalis
atgttttttactggtaaagaaaggaatttgaaatttgctattaagaagaaacacggtggcggtggtgcagcatcagtaattatcggatgtattattttcggaagtattgcgtttggtgggacaacattagcttacgctgatgaagtgcataatagtataaatcaggatatacaagattctggtagtacaattattggagaaaatgattcttctaccaaatcagctgagtataaaatgattcatgaaattgatggaactaaaattagtaacggtgaaaatagtaaagaaacaactacaagttcaggaactatactggctgaagaagcaatagaaagttcaaatcaaaaaaattcaaagacaagtgaagtcgaacaggatcttcataaagatgtatcaggatctgaatcagtaaaacaagtagaaacttctgattctataaaaaaatctgaagaatcagctgttaaaacattaaatctggatgattcacaagagaatactaattcaataactaccaaggcagaaaatgatgcgctatctacagttaatgatgaaaaagtattaaatgaaagtgatagtattatcaaatcaattccttcggaaacagagaatgtcgataataatagtaaaagtgataatagggacttagtagaaaactcagtggaaactactaaggaaataatgaaagaggctgataaaactgaaatagctaaaaggaatgacaatatctctgtattgaatgctggaactgaatcatttaatgatagtgataaaataagaagatctaaaagagataatgaatctcctgttccaagtttgagtattcaaatgccagtcacaaaagagatttacgaaaatgatagtactattaaaggaaagtctgaaccaggagtaacgataaaaatttataaaaatggtattgaactggggtctattaaagcagacgatgatggaaattttgaatatcctctagaatcacaagctatcaaaagtgataactactctttcgttgcggaaaaagatggagcgaaaagtatagagagctctgtaaatgtagtagaaaataaagaaatagtaggtaatcaacgagatgcgtatactccatatgggtttggtatatataatcgaggtttagttactactgatgatggaaagaaacattatacagttgatatggaggggaatttagcatctgaagcgtactttgatcttgcaggcggaacaatgtactattcaattgatgaaaaatttgcaccatatgttgaaaaaatagttctagatggtaaaacaattatttctaaaaatccgtatgaattgcccaataaaaccaatatttggtcttctggtattcttagtacagataaaagaggaggattggttcgtgctgctttagtgggtcgtactaacggaacaatagatatttattttaaagatgatactcctcaagaagttctcaatagtgaaatacctttccaagtttgggctagatttaaagagaaaaaagagggagtaaaaaatgatctaatttctgattttgatctaaatattttacttcaaaacaataaattaatattaagtaaagatacctttttcaaagatgaagatattgtcaataataatggtcctaaaattagttctaattttaactataccaataatactattgatattaattatggagtaaatactggtaattatggcttaacgatagggaaacgtagtccttataacttgcatattaatacagggaaagaattaagtgatttagttgatacgataaagattgacaataaaaattatgagttcgaaaaacttcctgatggttcgttagtgattaaagatatatacaaaaagggaattttaggtggagcattacttaaccgccaagagattacaatcagtttaggattaatagcgaaaaaaaatctgggcgatctcattgatttcaaacaagaattattaaaacttgatgtatctattagagataatacaacctttaagctagtaaaaggagaagctacagaagctatccgtaaaatagattcctcattcgatacatttaaacaggaattaacgaaatggattgaaaaaagagatagtaatccacaggaacctataactattaattctggagacaatacttctatagtggatcctaaagagatggttgaatttgcagtaaaaaatccaaccacagaaaatattaataaagcacgtagtttggtttctaaaatgtggctttgggacaaaaacaaatataatccagttcttaatgctgctgaagaagtaaacagatatctttcaactacgttaaatggttcatcaaatgatgatggcttgatattaaataatactcatgcggcaactttcgttaaattaattgatacggataaagatgggatacttgatagatacgaagcaaacatgggaattggaaccaactacacaaatgctgattctgatggtgatggaaaaagtgacggatttgaaatttttaatgatactgatcctttggtgagtccgtacgattggtttgataaaaatggagaaaaaataaaaatagtaacaaccgatactgatacgataagtggaagaataggaaataacaactatgatactgaaaatgtctaccctagaactgttcaattaataaaggttactgataacggagaaaatctgatttctgaaattagttcttctgaagatagaaaagggacttttgaatttactggattgagtggtaaattaagcaagggagatagactcgttgttaaaattattactaatgaagtacaaagagaaattgatcgacaaagaaatgttgttcaagttggttatgataatccagaggtatctgaagaagtaattgttcagggcgcacaagtaacagtctcttttgactttaattataatcaaactgatcctgactttgaccgtcaaccagttactcaagtagtagaattagaaaaaggttcaaggcttttaaatagttattttactccagaacgaaaaggctataaatttattggatggaatactgataaacttggagtaggacaaactgtcaatgatggttctagttttaatgaagatataacggtatttgctcaatgggaaaaagaacctaacctagctggagaagtacatgctccacaaggtcctattgaagaaggtaaaagtattgttctaaataatgtagtacagtccaataaatcagggtctgtaattgtaactggagaacttccaaaagggctctttgggttatctataaatgaaacaggtaatctaattggtactccacttatcaatgactggattgatggagaaaatagtcgggaagtaaagattccagttacaattagtaatggtgacgaaaaggttatggtggaagttccattaacgatcctgcatgatactcgagcggcagacgcagtaaaagcagcagaagacgcaggcaaagctggagcagataagaaagccgaagtggaaaccgacggtttagtgactccagaggaaaaagcggcagtggatggcttgaatgacacgactaccgcgaagaaagaagacgcaagcaagttagtggatgccttgccagaaggaccagtaaaagatagcttgaaagatcgcttagataaagtgacaacctctgaagtaacagtgaatgatgcagatagcaatggcaaagcggacgatgtagatttagctgaaaaagcagcggcagacgcagtaaaagcagcagaagacgcaggtaaagctggagcagataagaaagccgaagtggaaaccgacggtttagtgactccagaggaaaaagcggcagtggatggcttgaatgacacgactaccgcgaagaaagaagacgcaagcaagttagtggatgccttgccagaaggaccagtaaaagatagcttgaaagatcgcttagataaagtgacaacctctgaagtaacagtgaatgatgcagatagcaatggcaaagcggacgatgtagatttagctgaaaaagcagcggcagacgcagtaaaagcagcagaagacgcaggtaaagctggagcagataagaaagccgaagtggaaaccgacggtttagtgactccagaggaaaaagcggcagtggatggcttgaatgacacgactaccgcgaagaaagaagacgcaagcaagttagtggatgccttgccagaaggaccagtaaaagatagcttgaaagatcgcttagataaagtgacaacctctgaagtaacagtgaatgatgcagatagcaatggcaaagcggacgatgtagatttagctgaaaaagcagcggcagacgcagtaaaagcagcagaagacgcaggtaaagctggagcagataagaaagccgaagtggaaaccgacggtttagtgactccagaggaaaaagcggcagtggatggcttgaatgacacgactaccgcgaagaaagaagacgcaagcaagttagtggatgccttgccagaaggaccagtaaaagatagcttgaaagatcgcttagataaagtgacaacctctgaagtaacagtgaatgatgcagatagcaatggcaaagcggacgatgtagatttagctgaaaaagcagcggcagacgcagtaaaagcagcagaagacgcaggcaaagctggagcagataagaaagccgaagtggaaaccgacggtttagtgactccagaggaaaaagcggcagtgatggct

SEQ ID NO: 381 - DNA, 1599 bp, Enterococcus faecalis
ttgccagaaggaccagtaaaagatagcttgaaagatcgcttagataaagtgacaacctctgaagtaacagtgaatgatgcagatagcaatggcaaagcggacgatgtagatttagctgaaaaagcagcggcagacgcagtaaaagcagcagaagacgcaggyaaagctggagcagataagaaagccgaagtggaaaccgacggtttagtgactccagaggaaaaagcggcagtggatggcttgaatgacacgactaccgcgaagaaagaagacgcaagcaagttagtggatgccttgccagaaggaccagtaaaagatagcttgaaagatcgcttagataaagtgacaacctctgaagtaacagtgaatgatgcagatagcaatggcaaagcggacgatgtagatttagctgaaaaagcagcggcagacgcagtaaaagcagcagaagacgcaggtaaagctggagcagataagaaagccgaagtggaaaccgacggtttagtgactccagaggaaaaagcggcagtggatggcttgaatgacacgactaccgcgaagaaagaagacgcaagcaagttagtggatgccttgccagaaggaccagtaaaagatagcttgaaagatcgcttagataaagtgacaacctctgaagtaacagtgaatgatgcagatagcaatggcaaagcggacgatgtagatttagctgaaaaagcagcggcagacgcagtaaaagcagcagaagacgcaggcaaagctggagcagataagaaagccgaagtggaaaccgacggtttagtgactccagaggaaaaagcggcagtggatggcttgaatgacacgactaccgcgaagaaagaagacgcaagcaagttagtggatgccttgccagaaggaccagtaaaagatagcttgaaagatcgcttagataaagtgacaacctctgaagtaacagtgaatgatgcagatagcaatggcaaagcggacgatgtagatttagctgaaaaagcagcggcagacgcagtaaaagcagcagaagacgcaggcaaagctggagcagataagaaagccgaagtggaaaccgacggtttagtgactccagaggaaaaagcggcagtggatggcttgaatgacacgactaccgcgaagaaagaagacgcaagcaagttagtggatgccttgccagaaggaccagtaaaagatagcttgaaagatcgcttagataaagtgacaacctctgaagtaacagtgaatgatgcagatagcaatggcaaagcggacgatgtagatttagctgaaaaagcagcggcagacgcagtaaaagcagcagaagacgcaggtaaagctggagcagataagaaagccgaagtggaaaccgacggtttagtgactccagaggaaaaagcggcagtggatggcttgttagaaataaaacagtcttcatttatgccgtttgaaaatttattttcgactacaaatgattactcacagtttcctaaaactggtgaaaaatctgattctattttaaccatttatggaggtttattattcttaagtagtataggattattaggaataaaaaaaagaaaaaataatacgaat

SEQ ID NO: 382 - DNA, 1398 bp, Enterococcus faecalis
atgaagcgaaaaattaattatacacatattgctgaacctactgtttttgagaatgtttttccaacgtatttgacgaatgaaacgatgatggcgcgcaagcagaaagtattacaacgaatggaaacagaaaaattcgatcaattggtcttctatgcagacaaagagcatggcagtaattttgaatacttaactggctttattccgaggtttgaagaaggacttcttgtgttaaataaggatggtgcggcgacacttattttaggtaatgaaaatttaaaactgtgccaacatgcccgcatctcagccgatttaattcattatctagctttttcactacctaatcaaccaatggctggggaacaaaagttgtcgcagatttttgaaacgcttctcgatgaaactgctcaaaaaataggtatcgttgggtggaaaatgtttacgacacaacagcaagaacctgctactatgtttgatgtgccacattttattgtcgaagcactgaaaaaagcgctgccgaaagaagctcgtttactaaatgggacccacttattgattggagcaaagggggctcgcgcaacaaataatgctaacgaattggcgcactatgaatatggggcgaatttggcttctcgcagtatgttaaaggccttaaatgcaattgaaataggacagcgtgaaacggacattggggctttgttaaatgatgaaggtcaaacgccgacggtagtaaccattgcggcaactggtcaacgttttgaatatgcaaacatgtatccgactgccaaagaaattcagttaggtgatgccttatcattaactacaggctacaaaggcggcttgtctagccgaacaggttttgttattgaaaacgagcagcaattgccagaagcgcaacgtgattatttagagcgcgtagcaaaaccctattttcaagctgtcgttcactggcttgaaaccattcgaatcggactgttagggcgagaaatgtaccaagcgattgaagaacagttaccaaaagaaatctatcactggcatttgaatcctgggcatttagtttcggatgatgaatggatgtcgtcgcctatttatccagattcagccattcgcttggaaagtggcatgctctttcaagtggatattattccttctgtacctggttatacaggggtgagtgcagaagaatgtgtggctttggctgatgaaacactgcaaaaagagattcagcaaacttatccagacatgtggcaacggattgcgacacgcaaagcctatttaaaggagacattaaagctcgatttaccatcggaggttttaccaatgtctaatttagttggttacttacggcctttttatttagctaaagacaaagctttgtgtgtagaaaaaccagcgcttaaa

SEQ ID NO: 383 - DNA, 1086 bp, Enterococcus faecalis
atgaaaaaagctagagtgatttataatccaacgtcaggaaaagagttaatcaaaaagaacttagccgatattttatctattttagaagaatgtggttatgaagccagtgcatttgcgaccacaccagaagaaaattcagcacgcaatgaagcacatcgtgctgcgcgggcaggatttgatttactagtagctgcaggtggagatgggaccattaatgaagtcgtgaatgggattgctccgttgaagcggcgccctaaaatggctattattcctgctggaacgacgaatgactatgcacgggccttgaagattcctcgtgataatatcgttaaggcagcagaagtgattaaaaaaaatcaaactgtcaaaatggatattggccaagccggcaaaaattactttatcaatattgcggcgggtggtcatttaacggaactgacttatgaagttccgtcagagttgaaaagtatttttggttacttagcgtacttagccaaaggagccgaaatgttgccgcgagtgaagccgattaaaatgcgcatgacgtatgatgaaggtgtgtacgaaggcaatgcatcaatgtttttcctagggctgactaactcggtgggtggttttgagcaaatcgtaccagatgctaaattagacgatggtaagttttcattaatcattgtaaaaacagccaatatttttgagattcttcatttagttgcgttaatgttaaatggtggaaagcatgttgaagatcatcgactgatctatacaaagaccagctatttacatgcagaaacgttagaaaagaacaataaaatgatgattaatttagatggtgaatatggaggcgatgctccaatgacctttaaaaatatgcatcaacacattgaaatttttgcaaatggtgatgcactgccgtccaatgcaattatgggttctgtcttaactggtagcgatgagattgtcgtagaatcagaagacgaagaggaagaagcatataacgaagccagcaaagaatttgtcaaagaagttgaacgactaacagacgaagatattgatggcgatggaaagattgcggaaaaagaaaagcac

SEQ ID NO: 384 - DNA, 2763 bp, Enterococcus faecalis
atgaccaatacggtgaaagtgaaagacgacagtctggctgattgtaaacggatattggaaggacaagctactttcccagttcaagcgggtgaaacggaaccagtcgatttagtagttgttgaagatgctagtggtagtttttcagataattttccacatgtaagacaagcgattgatgaagtggttcaaggcttatctgatcaagaccgcgtgatgctggcttcatatcgcggcggaaaacaatttatgtttcctgatggaaagacaaaaattaattcagctgattatgatatgaatgtgcgcgtcaatacgcaattgacttatgataaaagccaatttgtctctggttttggagacgttcggacgtatggtggtacgccaaccgccccaggattgaaactcgctttagatacgtacaatcaaacacacggagatttaacgaatcgaaaaacgtatttcctattagtgacagatggggtcgctaatacacgtttagatggttacttgcataagaccaataccaatgattcaatcaatgaatatccagatccaagacatcctcttcaagtctcagtggaatatagtaatgactaccaaggtgcagcagcagaagttttagcgttaaaccaagaaattactaaccaaggctatgaaatgattaatgcgtattgggaaagtgttgaatctttaagttcagtgaattcatactttgataaatataaaacagaagtgggtccttttgtaaaacaagagttgcaacaagggtctagcacaccagaagattttattacaagccaatctattgatgattttacaacccaattaaaacaaattgtcaaagatcgtctggcgcaatcgacaccagcaacagcttcattaacgattgccaatcaatttgatattcaatctgcgaccgctacggacgatgctggaaatgatgtgcctgttcaaattaacggacaaaccatttcagcaactagtacagaaggttacgtaggaaacatcacgattcactacgaagtcaaagaaaatacagcgattgatgcagcaacccttgtaagtagtgggacaatgaatcaaggaacaattgctaaggaatttccagaagcgacgattcctaaaaatgacaatgcgcatgcgtgtgacgtgacgccagaagatccaacgattacaaaagatatcgaaaatcaagaacacttagatttaaccaatcgtgaagatagtttcgattggcatgtcaaaacagcctttggcaacgaaaccagtacttggacccaagccagcatggtggatgacattaataaagtgctagatatcattgatgtgaaagtcaccgacgaaaatggtaaagatgttacagctaacggcacagtaacacaagaaaataacaaagtaacttttgaaatgaacaaacaagcagacagctatgactatttaagtggtcatacgtatacaatgactatcaccactaaaattaaaactgacgcaacggacgaagaattagcgccttacattgaacaaggcgggattcccaaccaagccgacttaaactttggcaatgaaggtgacgtgttacattccaacaaaccaaccgtaacaccaccgccagttgatccaaatattgctaaagacgtagaaggacaagaacatttagatttaaccaaccgcgatcaagaatttaaatggaacgtcaaaacagctttcggtaacgaaacaagcacttggacccaagccagcatggtagatgacattaataaagtgttagacatcactgatgtaaaagtcacagatgaaaatggtaaagatgttacagctaacggcaaagtaacacaagaaaataacaaagtaacttttgaaatgaacaaacaagcagacagctatgactatttaagtggtcatacgtacacaatgaccattactactaaaatcaaagctagcgcaacggacgaagaattagcaccttatattgaacaaggtggcattcccaaccaagccgacttgaactttggcaacgaaggtgacgtgttgcattccaacaaaccaaccgtaacaccacctgcaccaacgccagaagatccaacgattacaaaagatatcgaaggccaagaacatttagatttaaccaaccgtgaccaagaatttaaatggaacgtcaaaacagctttcggtaacgaaacaagcacatggacccaagccagcatggtggatgacattaataaagtgttagacatcacagacgtgaaagttactgatgaaaatggcaaagatgttacagataatggcatagtaacacaagaaaataacaaagtaacttttactatgaacaaaaaagatgacagctactcttacttagctggtcatacatacacaatgactattaccactaaaattaaaactgacgcaacggatgaagaattagcgccttatattgaacaaggcgggattcccaaccaagccgacttaaactttggcaacgaaggtgacgtgttgcattccaacaagccaaccgtaacaccgcctgcaccaacgccagaagacccaaaaaaacctgaacctaaacaaccgctaaaaccgaaaaaaccgttgacgcctacaaatcatcaagcaccaacgaacccagtcaattttggaaaatcagcaagtaaaggaattcatttaccaatgactaatacaacagtaaatccactttacatgatcgcaggtttaattgtccttatagtggctattagctttggcataacaaaaaataaaaaaagaaaaaat

SEQ ID NO: 385 - DNA, 1785 bp, Enterococcus faecalis
atgtctgcttggcaaacatttaaaaatggaacaaggcaattttttaaagacatcttgcagtatttatggttattttttactttaaatgtcttattattattggtgggtggggcttttagttgggctacttccaacgcactaaaaactcaaggtattccttatctttcgtttaataacctgaatttattgttagaaaagccgcttgctctggtgttattaattctcttgttgttactttttttaggtgcagttttttatcagtttacctttttattattagggatttttcaaatacggcaagaccatcgctttcattttaaaggagttaccaaggcatcttttaaggttcttaaaaagcaaggtgcccgttcgtggttattctttttcggttattttgttgtcattgtcccttttggtaacctgattttccaaagtaatctattgacgaaatttgtgattccagattttattgttgaatttttgtcccaacgaattccttacttggtggggttactggcctttgggttattagtctggtatttagctattcgtttcatttacacgcttccattaatgattctggagagaaaaaaagcgggcgaggcagttaaggctagttggtcaatgacaaacaaacgattatggttcattattcgtaatattgcatttgtgacgatcgcggtatttgtttcaacgtatgttatttatgtgttactttatcttctacagttgaagttagataccttgagcgataccattagcttgctaggtgggattttaaatttaaccgttgtccaatttttacagtttgtctctaatgcttggctttcagtattactgattaatttcttatatacacaattaaatgttcaagcagaaacgacgacaaaagttgcctttgacaaagaaacgaaacgtaataaattagtgactatcgggatgggcctaggactattcaccatttttggcggctatataattttcaacgctgtttacttaacagggctattagaatcaaaacctttgattatttcgcatcgaggggtcaccaatagtaatggcgtacaaaataccattcctgctatggaaagaaccattaaatttaaaccagattatattgaaattgatgttcaagaaaccaaagaccatcaatttgttgtgatgcatgatgcaaaccttcaagaactcgccggcgttgatggcacgccgcaagaatttacgttggctgaattaacaaaaatgaccgttaaagaaaatggccaagaagcaccaattgccagttttgatgattatttagcgaaagcaaaccaagccaaacaaaaattactagtagaaattaaaacgtctaaacaagatagtcaaggtgcgctttctaactttattgaaaaatatgaacgtcctctgataaagaataaccatcaggttcaatctctcgactacaatgtgatcaaagcgtttaaaaaagccaaatcaaaagtaaaagttagttttattttgccctataatttcacttttccagaaacacaagctgatttgtatacaatggaagctactacgttgaatgataccttcattttaaaagctgaccaacagaaaaaagcagtttatgcttggacagttaatgactcagaggtattgagtaaaatgctctttatggacgttgctggagtgattaccgatgatttggagttagtcaatgaagaagtcaatgactttgaaaaaaatccgtcgtatgcggatcgtattttgcattatatttttatgctaccaagtgtggcttctcaa

SEQ ID NO: 386 - DNA, 3309 bp, Enterococcus faecalis
atgataacagatgagaatgataaaacgaatattaatatcgagttaaatcttctcaaccaaacagagcagccattacaacgagaaattcaattgaaaaatgcacagttcatggatactgctgtaattgaaaaagacggatattcttaccaagtgactaatggtacgctttatctgactttggacgcacaagtaaaaaagccggtacagctttcgttagctgttgagcaaagttcgcttcaaacagctcagccacctaagttattgtatgaaaacaacgaatatgatgtttcagttacttctgaaaaaataacagtagaggattctgctaaagaatcaactgaaccagaaaaaataactgtaccagaaaatacgaaagaaactaacaaaaatgattcggctccagaaaaaacagaacagccgaccgcaacagaagaggtaaccaatccatttgcagaagcaagaatggcgccagctactttgagagcgaatctggcactgcctttaattgcaccacaatacacgacggataattctgggacttatccgacagctaattggcagcccacaggcaatcaaaatgtgttaaaccatcaagggaataaagacggtagtgcacaatgggacggccaaacgagttggaatggggaccctactaatcgcacaaattcttatattgagtatggcggtacaggagaccaagccgattatgccatccgaaaatatgctagagaaacaacaacaccagggctttttgatgtatatcttaatgtgcgtgggaatgttcagaaagaaatcacgccattggatttggtcttagtcgttgactggtccggtagtatgaatgaaaacaatcggattggtgaagttcaaaaaggagtgaaccgttttgttgatacattggcagatagcggtattaccaataacatcaacatgggctatgttggctactcaagtgacggttataataacaacgccattcaaatggggccgtttgatacagtcaaaaatccaattaaaaatattacgccaagtagcactagaggaggaactttcactcaaaaagcattaagagatgctggtgatatgttagcaacgccaaatggacataagaaagtcattgtacttttaacggatggcgtcccaaccttctcttataaagtgagtcgagttcaaacagaggcggatggtcgcttttacgggacacaatttacgaatcgacaagatcaaccaggtagcacttcttatatctctggtagctataatgcgccagatcaaaacaatatcaataaacggattaacagtacgtttatcgccacgataggtgaggcaatggtcttaaaacaacgtgggattgaaatacatggattgggcattcaattgcaaagcgatccacgagctaatttatctaaacaacaagttgaagataaaatgcgtgagatggtgtcagccgatgaaaatggagacctttattatgaatccgcggattatgcaccagacatttctgattatttagcgaaaaaagccgttcagatttcaggaacggttgtaaacggaaaagtagttgatccaattgctgaaccttttaaatacgagccaaatacattatcaatgaaaagtgtgggtcctgttcaggttcaaacattaccagaagtgtcgctaacaggcgctacaattaatagtaatgagatttatttgggtaaagggcaagaaattcaaattcattatcaagtacgtattcaaacagagtcagaaaacttcaaacctgatttttggtatcaaatgaatggtcggacaacgtttcagccattagccacggcccctgaaaaagttgattttggggttccttcgggaaaagcacctggcgtgaagttaaacgtgaaaaaaatctgggaagagtatgatcaagacccgacaagtcggccagataatgtgatttatgaaattagtagaaagcaagtaactgacacagccaactggcaaactgggtatattaaattatcaaaaccagaaaatgataccagcaatagttgggagcgcaaaaatgtaacccaactttccaaaaccgcggatgaaagctatcaagaagttcttgggcttccccaatacaacaatcaaggacaagctttcaattatcaaacaacccgtgaattagcagttcctggttacagtcaagaaaaaatcgacgatactacttggaaaaacacgaagcagttcaagccattagatttaaaagtaatcaaaaattcttcctcaggtgagaaaaacttagtgggagccgtctttgaattgagtggtaaaaatgttcaaacaacattagtggacaataaagatggtagctattccttgccaaaagatgtgcgcctacaaaaaggggaacgctatacattaactgaagtaaaagcacctgcaggacatgagttaggcaagaaaacgacttggcaaattgaggtgagtgagcaaggcaaagtaagcatcgatggacaagaagtgaccaccacaaatcaagttattccattggaaattgaaaataaattttcttctttgccaatcagaattagaaaatacaccatgcaaaatggcaaacaagtgaacttagcagaggcgacttttgcgttgcaaagaaaaaatgctcaaggaagttaccaaactgtggcaactcaaaaaacagatactacaggattgagctattttaaaattagtgaacctggtgagtatcgaatggtggaacaatcaggaccattaggctacgacactcttgctggaaattatgaatttactgttgataaatatgggaaaattcactatgcaggcaaaaatattgaagaaaatgcgccagaatggacactgacacatcaaaataatttgaaaccttttgacttaacagttaataaaaaagccgataatcagacgccacttaaaggagcgaaattccgtttaacaggaccagatacggatattgaattaccaaaagatggcaaagaaacggatacttttgtttttgaaaacttaaaaccagggaaatatgttctaacagaaacctttacgccagaaggatatcaggggttaaaagaaccaatcgaattaataattcgtgaagatggttcagtcacgatagatggggaaaaagtagcagatgttttaatttctggagagaagaataatcaaattactttagacgttacgaaccaagcaaaggttcctttacctgaaactggtggcataggacgcttgtggttttacttgatagcgattagtacattcgtgatagcgggtgtttatctctttattagacgaccagaagggagtgtg

SEQ ID NO: 387 - DNA, 1467 bp, Enterococcus faecalis
atggggattttgttaccgattattattgcagttttagtattattaatgttattaattgtgtttgtttctaaatatcagacagccaaacctgatgaagcgttaattatcagcgggagctatctaggctctaaaaatgttcatgtagacgaaggtggcaacaaaattaaaatcgttcgtggcggtggtgcgtttgtcttaccagtgttccaacgttcaaatcgaattagtttgctttcaagtaaattagatgtttccacaccagaagtgtacacagaacaaggggttcctgtgatgtgtgatgggacatcaatcattaaaattggttcgtcagttgaagaaattgcgacagcagcggaacaatttttaggaaaaacaacggaagaattagaaaatgaagcacgtgaagtattagaaggacatttacgttcgattttaggttcaatgacagtggaagaaatttaccaaaatcgtgattaatttagccaaagtgtacaagaagttgccagtgttgacttagctaaaatgggcttagttattgtgtcgttcacaattaaagaagttcgtgataaaaatggatacttggattcattagggaaaccaagaatcgctcaagttaaacgtgatgcagatattgcagaagcagaagccttgaaagaaactcgcatcaaaaaagcagaagcagaaaaagaatcacaacaagcggaattgcaacgtcaaacagaaattgcagaagcttcaaaagaaaaagaattgaaattagcgttatacaaacaagaacaagatattgccaaagccaaagcagaccaagcctataacttggaaagcgcgcgtgcacaacaacacgtggtggaacaagaaatggaagtcaaagtcgttgaacgtcaaaaacaaattgagttagaagaaaaagaaattacgcgtcgtgaaaaacaatacgactcagaagtgaagaaaaaagccgatgcagatcgttacgcacgcgaacaagaagctcttgctcaaaaggcacgcgaagtggcagaagccgaagcagaacgcttcaaagttgaagcattagccgaagcggaagccaacaaaacgcgtttaacaggtcaagcgcaagccgaagctattttagctcgtggtgcagcggaagccgaagccaaacaaaagattgctgatgccttcaaagaatatggtgaagcagctgtgttaagtatggtgatggaaatgttgccacaattaatgaaagaagcagcacaaccattgggcaacatcgacaagatttcagtggtagatacaggcgcaggtggcgaaaattctggcgccaaccgtattacaaattatgcaacaaatttgttggctggtacacaagaaacactaaaagaaacaacgggcctcgacgtgaaagagctaattgaaaacttttctaaaaaaggtacctcaaatagcgtgaactatcatgcaacagaaggttcagaaaaagaa

SEQ ID NO: 388 - DNA, 1617 bp, Enterococcus faecalis
atggcttatcagtttaaattaccggatatcggtgaagggattgccgaaggcgaaatcgttaaatggtttgtaaaacctggcgatacaatcaacgaagacgatacgttattagaagtacaaaatgacaaatcagtggaagaaattccatcaccagtaacaggtactgtaaaaaatatcgttgtaccagaaggaacagttgcaaacgttggtgacgtgttaatcgaaatcgacgcacctggtcacgaagataacgatgcagcaccagcagctcctgcacaagaacaaacaccagcacaacctgctgctgtaccaacaaccgaagcagctggcggatttttccaattcaaattaccagacatcggtgaaggaattgccgaaggcgaaatcgttaaatggttcgttaaagcgggcgacacaattaatgaagatgattcattattagaagtacaaaatgacaaatcagtagaagaaattccatcaccagtaacaggtactgtaaaaaatatcgttgtaccagaaggaacagttgccaatgtgggtgacgtgttagttgaaattgacgcacctggtcataattcagcagcaccgtcagtcgcagcaccagctactgacgctcctaaagcggaagcatcagctccagccgcttcaacaggcgtagttgcagccgctgatccaaacaaacgcgttttagcaatgccatctgttcgtcagtatgcgcgtgaaaaagacgttgatattacacaagtaactgcaactggtaaaggtggccgtgtcattaaagcggatattgatgcctttgtctctggtggttctcaagcagccccagctactgaagctgccgcaacagaagcagcacctaaagcggaagcagctgcacctaaagcagcgccaaaagcctttacttctgatttaggcgaaatggaaacacgtgaaaaaatgacaccaacacgtaaagcaattgctaaagcaatggttaacagcaaacacactgctcctcacgtaacattacatgatgaagtagaagtttctaaattatgggatcaccgtaagaaatttaaagatgttgctgctgcaaatggtacaaaattaacattcttaccatacgttgtaaaagcattgacttcaactgttcaaaaattcccaatcttgaatgcatcaatcgatgacgcagcacaagaaattgtttacaaaaattactttaacattggtatcgctactgatacagatcatggcttatatgtaccaaatgttaaaaatgctaatacgaagagcatgtttgctatcgctgatgaaatcaacgaaaaagcagcattggctatcgaaggtaaattaactgcacaagatatgcgtgatggtacaatcacaattagtaacattggttcagtcggtggcggctggtttacaccagtaatcaactaccctgaagttgctattttaggcgttggtacaattgcacaagaaccagttgttaatgcagacggcgaaatcgttgtgggacgcatgatgaaattatcattaagctttgaccaccgtatcgttgacggcgcaactgctcaaaaagcaatgaacaacattaaacgcttattagctgatccagaattactattaatggaagga

SEQ ID NO: 389 - DNA, 750 bp, Enterococcus faecalis
atggaatatacaattaaaaaaatggcttcactatctggcgtcagtgcacggacgttacgatattatgatgaaattggtcttcttcaaccagccagaattaattcttctggttatcgaatttacgggcaagccgaggtgaatcgtttgcaacaaattcttttttaccgtgaattggatctgaaactagatgaaattaaagaaattttggagcaacctgactttaatgttgaacaggctttatacgagcatcaacaaaaactattggaaaagcgcaatgaaattgatcgtcttttagcctctgttcaacaaaccttacaccattacaaaggagagataaacatgtcagatcagcaaaaattcgaagcattcaaacaacaaaaagttcaagaaaacgaagaaaaatatggtaaagagattcgggaaaaatatggcaacgaaacgattgaacaagccaacaaaaaatatttaaacttgacggaaaaagacatgcaagcaatgcagaacgtggaaaaagatttattttctaagttagccatgtatcaaaaatcacccaagttgactagccaacttgcgcaagaaattttccaattacacaaagattggttaatgtactcttggtcaagctattcgccagaagcacacaaagggttaggccttatgtatgttggcgatgaacgatttacgtcatattatgaacaacacggcgctggttttgccgaagcgttaaacgcaattatccaaaactacgct

SEQ ID NO: 390 - DNA, 585 bp, Enterococcus faecalis
atggctaaaaaaggcggatttttcttaggagcagtaattggtggaacagcagcagccgttgccgcattattacttgcaccaaaatcaggtaaagaattacgtgatgatttatcaaatcaaacagatgatttaaaaaacaaagcgcaagattacacagattatgctgttcaaaaaggaacagaattaacagaaatcgcaaaacaaaaagccggcgttttatcagatcaagcctctgatttggcaggttctgtcaaagaaaaaacaaaagattcattggataaagcacaaggtgtttctggcgacatgcttgataactttaaaaaacaaacaggtgatttatctgatcaatttaaaaaagcagctgacgatgctcaagatcacgcagaagatttaggtgaaattgccgaagatgcagcagaagatatctatattgacgttaaagattctgcggcagcggccaaagaaactgtttctgctggtgtcgatgaagcaaaagaaaccaccaaagatgttcctgaaaaagctgcagaagcaaaagaagatgttaaagatgcagcgaaagacgtaaaaaaagaatttaaaggg

SEQ ID NO: 391 - DNA, 321 bp, Enterococcus faecalis
atgaaaagaaaactaacaaaatctccgaataacgtggttttaacaggaagcttagctgggattgctgattggctaggaattgacccaacaattattcgtgtcgtttatgtcttgctcagctttttctcagcaggatttccaggcattctcttatacattgctttagcagtcttgatcccttctggaagaacaggaagcgatcgcggctacggccatcaaaatccttataatagaaatgttcgcaatgaaaatccttatgctgccaataaaaagcaacgtaaagaagcggaaaaaattgatgatgacgaatggagtgacttt

SEQ ID NO: 392 - DNA, 1599 bp, Enterococcus faecalis
atgaaagaaagagaacgcgtattagaattagtgaaaaaaggtattctaacgtcagaagaagcgttaattttattagaaaatatggcaactgaaaaagatgaaaaacaaatcgaaaaagctgctgaaaaagttgatacacaaaatattggaacaacaaataaagaagatcaagtcgcagatttaatgaatgcattagaaaaaggcgaatcagaaggacctactgttgattcgtttgaagaaaatacacaggacagtgcagaaaaagatcgtgaaaacttagaaagaattcttgatgagttagcaacaaaagccaatcgtgcttcggctgaattggacgaagtcaacgcagaaattgccggcatcaaagaagaaattaaagaagtcgcagaagaaattggaacattagatacaaaagaagaattagatgcattaacagaagatgaacaagttcaacgaaaagacttgcacgttttacttgcacaattagaagaaaaattagcgactcaaagtactgaaaaaacagcactggaagaagaactaaaaaacattcgcaaagaacaatggaaaggtcaatggaatgatacaaaagaaaaagtttcttctcaattctctgaagagtggaaagatcaagccacagacacctttaaccaagtcggcggcaaagttgccgaagttggtggtcaagtgggagaattcttgaaaaaaacatttaattctttcagtgataccatgaatgataatgtggaatggaaagacattaaaatgaaagttcctggtgtggcaacaactaagtttgaacatgagtttaactatccaaatccacaagcaagtttaattgatgtcaaggtagcaaatggtaccgtggttttcaaaacttgggatcaagaagatgtgaaagtcgaagcaaaaatcaaattatatggtaaaatggcaggagattcaccaatggaagctttcttagaacgaagtgacattgatgtggatgatgaaacgatttctttccaagtgccaaacaaacgggtgaaagcagatttaacgttctatttaccaaaacgcacttacgatcatgtatctgttaaattattaaacggaaatgtcttagtagaagagttaacagcgaaagatgtttacacaaaatcaacgaatgggacgattacgtttaaaaaaattgatgcaactatgttagaaattgaaggtgtgaatggtgaaattaaagtcctagaaggaacgattttagataacattattgaaacagtcaatggtgatgtgtctatttccgcggcaccagaaagtctaagtgtctctctgattaatggagatatccgcattacagctaaagaaaaaacgcttcgccgtgttgaagcaagctctgcaaatgggaatatcaaattggccttgccaaatgacttaggtgttgaagggcaagtgaaaactaatttaggtagtattaacagccgtttaacagatattgaagttgttcgtgaaaagaaagatcgcggcaatcaacaattacattttagacgtgtactggaagaatcaatggctcaaattaatgcttctacaacaacgggaagtattttcctaaaagatacggataaa

SEQ ID NO: 393 - DNA, 1638 bp, Enterococcus faecalis
atgaaaaagtatttaaaaatcacaatggtttgtattttattggtaggatttttagctgggtgtaccaataaaaatgaaaataaaaagaaacagaaaaataccaaagaagccgttcaactgatgtcaccctcggaattaacaacgctcaacacctctgtattattggattttccagatgctattgtccaaactgcagcgtttgaagggttatatagtttagatgaacaagaccaattggtaccagccgtagcaaaagcattgccgatgatttcagaagatggaaaaacctacacgatttctttgagaaaagaagcggtttggagtaacgatgatcctgtcacagcacatgattttgaatatgcttggaaaaaaatgattgatcctaaaaacggctttgtttatagcttcctcatcgttgaaacaattcaaaatggtgcagaaatctcagcggggaaattagcacccaatgaactaggtgtcacagctgtggatgattatacattaaaggtgacgctcaaagagccaaaaccgtactttacgtccttgttagcttttccgacatttttcccgcaaaatcaaaaagtagtcgaacaatttggtgcggactatggaactgctagtgataaagtcgtctataatggtccgttcgtggtaaaagattggcagcaaacaaagatggactggcaactagcaaaaaataatcgctattgggatcaccagaacgtgcgctcagacattatcaattatacagttatcaaagaaacatctaccgcattgaatctttttgaagatggacaattagatgtggctacactaagtggtgaactggcgcaacagaataaaaataatacgttgtatcattcgtatccaacagcgacaatgaactatttgcgcttaaatcaaaaacggaaagggcaagcaacgccgcttgcaaacgaaaacctgcgtaaagcattggctttaggaatagataaagaaaatctagtcaataatattattgcagatggttctaaagcgctacatggtgcgattacggaaggctttgtggcgaatcccacaacgggtctcgattttcgtcaagaagcaggtaatttaatggtttataacaaagaaaaagcgcaaagttattggaaaaaagcacaagcagaattaggagaaaaggttaacgttgaattgatggtaacagatgatggttcttacaaaaaaattggtgaaagtttgcaaggctcgctacaagaattgtttcctggtttgacaatagagctaaccgcattgccgactgaagctgcattgaactttgggcgagaaagtgactatgatttattcttaatttactggacaccagactatcaagaccctatttctaccctgatgactttatacaagggcaatgatcgcaattatcagaaccctgtctatgacaaattattagatgaagcagccacaacctatgccttagagccagaaaaaagatgggcgacactgattgcagctgaaaaagaagtgattgaaacgactgctggcatgattccacttagccaaaatgaacaaacagtcctgcaaaatgataaagtcaaaggcttgaattttcatacctttggcgctccattaacgttaaaaaatgtttataaggaaaaa

SEQ ID NO: 394 - DNA, 3972 bp, Enterococcus faecalis
atgaaacatggaaaaataaaacgatttagtacattgacactattggcaagcgcaacgattttagtaccattaagtacgtctgcagaagaaacaacaaacagcagcactgaaacaagctcatcaatggtggaacctaccgcaacagaagaaaaattgtggcaatctgattttccaggagggaaaactggtgagtggcaagatgtgattggtaaaacaaatcgagaattagcaggagagtcattggcgatttcacgagatgcagcagcaggtaataatgccgtatctttaaatttagattcccctaaattagctgatggtgaagtagaaacaaagtttaaatacactgctggaagcggtcgaacgggtgtgattatacgtggtaataccaaagatagctgggtttttgtaggctataacgcgaatggcaaatggttagttgaaagccctaattcgtggaatgattcaatttctgggccaacgttaaatgaagatacgaattatttgttgaaagtacgttatgttggtgaaaaaattactatctggcttaacaccacgttgatttacgaaggagaacctgttttggccaatggagacaaaattccaacagaagccggacatgtgggtgtccgtttgtggtacgacaaaaaaattgtcaattatgactattttaaaaatggccccgtagatagcattccagaaattgtgccagaagtgacacaaattgcgccagtcaaagtttttacaaaaattggtgtcgcaccaaaattaccgaaacaagtaaaagtgacctataatactggtaaagaagccaatgaagcagtccgttggaatgaaatcgatcctgatgcatataaagaaccaggaacttttgaagtcgacggtactttggaaaatacaaacatcaaagcaaaagccagcattgttgttgctaaagacaatgaagctgaaaaaggcgacaaaatctcttccgcagatttaacagccgtggttgatccacaatttccacgaattattcgctacgaagaccctcagagtaatcaagtgatttttaatggccaacacgagaaaattgaccaagtaatgattgatggcaaagcatataaagcaactgctgaaaaacagaagagtgaagcaaatcaagccgtttataacgtagctgtcccagaaattggtttgcgtttcacaacgacattgactgtttccgaaggccaagaattagctatgaaactctcagatattcgtgaagaaggaaccaaaatacacacaatttcaattccaaatcaaggcttgatttctgtcaatagtacagatgaaggggcgacttttgctggcgttgtgatgaatactgggacaaatgcaaataacggaaataaaaatggtgatactatccaagatttaactacaacaagccaagaagaaacgaaaaaatatatgtatggtttcttaaatacggcgaattatgctgcaagtttttggacgaacgcctatggagacggctctgtcgatggtagtgacaacaatcgaatccataaacaaacaaaagaagcggcgactggttttgtaacaaccttgtcaagtggggcatggacctatcgaccatttgatgcaccggaagattacacaactggagaaacgccagaagtgaaagttaaattctcaaaagatagcaacgacgacaatcgggtggattggcaagatgcggcaattgggttccgttcaattatgaataacccaatgggtgcggaaaaagtccctgaattagtcaaccaacggattccttttaactttgctagtcaggcgacaaacccattcttagtgacgttagacgaatcaaaacgtatttacaatttaacagatggattaggacaaatgaatttactaaaagggtatcaaaatgaaggacatgattctgcgcatccagattacggtgctattggtcagcgacctggtggggaacaagcgttgaatcaattaattgatgaaggacataaattaaatgccgttttcggtgtgcatattaatgacaccgagtcttacccagaagcaaaaggatttaatgaggaattagttgatccaacgaagcgtggctgggattggttagatccgtcttattttattaaacaaagacccgatacattgagtggtcgtcgctatgagcgctttaaagaattaaaacaaaaagcaccgaatctagattatatttatgttgatgtttggggcaaccaaggcgaatcaggttgggcaagtcgtcaactaagtaaagaaattaattcactcggttggtttacaaccaatgaatttccgaatgctttagagtatgactcggtttggaaccattggtctgcagaaaaagattacggcggtacaacaacgaaaggctttaacagtacaatcgttcgttttattcggaatcatcaaaaagacacttggattatttccgacaaccctttgttaggtggagctgaatttgaagcctatgaaggttgggtgggtaaaaccaattttaatacctatcgccaaaaaacttttgccattaatgtcccaactaagttcttacaacattaccaaattacaaactgggaaactacaacagcagcagatggtcaaatctatggcacaattaaattagcgaacggtgctgaaaaagtgaccgttactcaagcagatgctaattcgccaagaagcattacgttaaatgagacagaagttctaaaaggtgatgcgtatctactgccttggaatgtcaatggtcaagacaaactatatcactggaatccaaaaggcggtaccagcacttggtcattggataagaaaatgcaaggaaaaacgaatttacatttatatgaattaacagatcaagggcgtattgacaaaggcgcaattgccactacaaataaccaagtgaccatccaagccgaggctaatacaccgtatgtcattgctgaacctgacagtattgaaccgatgacatttggaacaggaacaccatttaaagatcctggatttaatgaagccaataccttaaaaaataactggaaagttttccgaggtgatggagaggttaaaaaagatgccaatggtgattatgtctttagttcagaaaaagaaagaaccgaaatcaaacaagatatcaatcttcctaaaccaggaaaatatagtttgtatctaaacacagaaacacatgatcgtaaagccacagtaactgttaaaattggtggtaagaaatatacgcggacagtgaataattcggttgcccaaaactacattcaggcagatattaaccatacaagcaggaaaaatccgcagtatatgcaaaatatgcgaattgattttgaaatcccagataatgccaaaaaaggctcggtgacattagcggttgataaaggcaattccgttacaaaatttgatgatttacgaattgttgagcgtcaaacggatatcatgaacccagacaaacaaacagttattaagcaagattttgaagacacacaagcagttgggttatatccgtttgttaaaggctcagctggtggtgtagaagatccacggattcatttatcagaaagaaatgaaccttacacacaatatggttggaatggaaaccttgtttcagatgtattagaaggcaactggtccttgaaagcccataaacaaggagcaggattgatgcttcaaacaattccgcaaaatattaaatttgaaccgaacaagaaatatacggtccaatttgattatcaaactgatggtgaaaatgtctttactgctgggaccattaatggggagttgaaaaataacaatgactttaagccagtcggtgagttaacttcgacagcagcagatggtcaaaccaagcattatgaagcagaaataattggggatgcttcaggaaacactacgtttggtatttttacaacaggtgccgataaagatttcattatggataactttacggtcacagtggaatcaaaaaaa

SEQ ID NO: 395 - DNA, 1530 bp, Enterococcus faecalis
ttgatgaagggaaataaaattttatacattttaggtacaggcatctttgttggaagttcatgtctattttcttcactttttgtagccgcagaagaacaagtttattcagaaagtgaagtttcaacagttttatcgaagttggaaaaggaggcaatttctgaggcagctgctgaacaatatacggttgtagatcgaaaagaagatgcgtgggggatgaagcatcttaagttagaaaagcaaacggaaggcgttactgttgattcagataatgtgattattcatttagatagaaatggtgcagtaacaagtgttacaggaaatccagttgatcaagtagtgaaaattcaatcggttgatgcaatcggtgaagaaggagttaaaaaaattattgcttctgataatccggaaactaaagatcttgtctttttagctattgacaaacgtgtaaataatgaggggcaattattttataaagtcagagtaacttcttcgccaactggtgaccccgtatcattggtttataaagtgaacgctacagatggaacaattatggaaaaacaagatttaacggaacatgtcggtagtgaagtaacgttaaaaaactcttttcaagtagcgtttaatgtgccagttgaaaaaagcaatacgggaattgctttacacggaacggataacacaggggtttaccatgcagtagttgatggcaaaaataattattctattattcaagcaccatcactagtagcattaaatcagaatgctgttgacgcctatacgcatggaaaatttgtgaaaacatattatgaagatcatttccaacgacacagtattgatgatcgagggatgcccatcttgtcagttgttgatgaacaacatccagatgcttatgacaatgctttttgggatggaaaagcaatgcgttatggtgaaacaagtacaccaacaggaaaaacgtatgcttcctctttagatgtagttggtcatgaaatgacacatggtgtaacggaacatactgccggtttagaatatttaggacaatcaggtgcgttgaatgaatcttattctgatttgatgggttatattatttcgggtgcatctaatccagaaattggtgcggatactcagagtgttgaccgaaaaacaggtattcgaaatttacaaacgccaagtaaacacggacaaccagaaaccatggctcaatacgacgatcgagcacggtataaaggaacgccttattatgatcaaggcggtgttcattataatagtggaattattaatcggattggttacaccattatccagaacttaggcattgaaaaagcacagactattttctacagctcgttagtaaattacttaacacctaaagcacaattcagtgatgctcgtgatgcgatgcttgctgctgcaaaagttcaatatggcgatgaagcagcttcagtggtatcagcagcctttaactctgctggaatcggagctaaagaggacattcaggtaaaccaaccaagtgaatctgttctggtcaatgaa

SEQ ID NO: 396 - DNA, 399 bp, Enterococcus faecalis
gtgcaacaaaacaacaatgagatatctacacaacaccaatttgatgcctactgtaaaaaagtattacgcaatgaagctaagtctattcgaaaacgaaacgataaaataaaagaaaatgaggaaccattaaatgatttaaatgaaggtaagtattcacaaactcatttagatgagcaagatgtttatttcttatttggaatggagatattaatttcagatcagaagttatcagcagcaattgatcagttatcggatacaaggaaaaagattgttttactttattattttgcaggttttaatgatactgagatcggtaaaattttcaacatgagtacaagtggtatctggtatcaacgaacgaaagcggttgaacaattgaaaatggaatatggcttatgg

SEQ ID NO: 397 - DNA, 2121 bp, Enterococcus faecalis
atgaaaaagaaactttttcggattgtgggaatcgtttttattagcatactcactctgatagttctattgagtttagttggtacggtagccgaggcgacagggctagttgatgatacagttgaatcaggaaatctatattccaaatattcactgaacaactatcaactagatttctttgtggatagctcttgggattggttgccttggaattggggtgatggcttagggaaaagcgtgatgtatggtctttatgccattactaatttcatttggacggtgagtttgtatttgtcgaacgccacgggttatgtggttcaagaagcctataaattagatttcatttcggatacggctgaaagtattggaaagaatatccaaacattggctgatattactgaaaatggactccagacctccggattttattttgggtttctattattgatgattttagctctgggggtgtatgtggcgtataccggattattaaaacgagaaaccacgaaagcagttcgagccgtgattaattttgtgatgatttttctactatcgggttcgttcattgcttatgcgcctacctatatcacaaaaatcaatgactttagctcagatgttagtgaagcggcccttacccttggaaccgagatcgttgtacccaattcagaaagccaaggaaaagatagtgtggatttgattcgggatagtttgttttcgattcaagtccaacaaccttggttactactgcaatttgatgattccaacatagaagaaattggtgaagaccgggtcaacaagattctatctgtgagtccagatgaaaacaaaggcaaagatcgggaagaagcggtcaaggcagagattgaagacaatgacaatgcgaatctcagtattaccaagaccatgaaccgtttagggatcgtggtctttttggtattgttcaatattggcatttccttctttgtttttcttctaacagggattatgttgttctcgcaaattctcttcattatctttgcgatgtttctgccaattagtttcttattgtccatgttgccgacttatgagagtttgggcaagatggcgattattcgtttattcaatacgattatgatgcgagcgggtgtcaccttggtgattacgactgcattcagtatttctacgatgtttttcaatatttcggctacctatcccttctttatggtagcttttctacaaattgtgacctttgccggtatctatttcaaattgggtgacattatgagtatgttcaaccttcagagtaatgacagtcagtcaatgggcagacgggtcatgcgaagaccgcaaatgttgatgaaccgtaaattgcggcaactcaatcgaaatgtgggccgaactctggcttttggcggtgctgcagcagttgggaataagttggcaaaggaacaatcaaaacccaaatttaagccagcaggttcttctctacgaaagaattcacgattacctaacgatcgcgaggtatcctcagactcggctaaggagaatccaatttcaaataataagaaacaatcccgaatgaatttgactgggagaaaaataggcaaagttctggatacccaggctttggtgaaagataaggcaaaacaagtaaaggatcaggtacggaatacgccgaccaacttgaaatacatcctccataaaggtctggaaaagacgaaaaaagcaccgaaagaatttaagcgagggcttgttcaagaaaaagcagatcgagagaagctgcgagacaaacaacgacaacgcagagatgagaaaatggatgaaaagcgaaaaaacttgggcgaagtaacagaccgtcatggaaaaagaagaagtaatgtttcgataaaagaggatccaaaacctcagaaggataggatactgaaaaatgaacttccaaaacggattgtgatggtaaaaccgaattctgaggtaaggagaagacttgttaaacagaatttggttgcgagagagaataaccaactattaagtaagaaaaattctttccagcaagttaagcaacgatctactcttccgaagagagccaatcaaaaagtacaaagaataatgaaggctcgtccaaaaccaaagtcgggtgataaaaaa

SEQ ID NO: 398 - DNA, 2679 bp, Enterococcus faecalis
atgaaaaaaatcatttcaggtatgttaatttgtactgtattattaaatagttttagtgtgattgcatcaggagaagagcttgtaaaaacagaaacaacgggggagactggcttggtcactcaagctacgtcagaaacaacgactaattcaacggaggatacatcttctgttacagaagaaaatacctctgaaagagatagttctacttcaagcacaaaagaagagtctcttgattcttcaacaaatagtacaacggaagaacattcttctgtttcagaaacaaacacaacagatagtaaaacagaagcatcacaaagctctgaagtagaaaaaaagaccattgaccaagatgaagcggattatcaagaagcagcacgtgaaggaacgaaccataaaaaaggaacatatgctatgaaaaacggcctttcttctagggtagcgcgagcaacagttgcgaacgtctatgcgaatgatcctaatttgcctggcaagaattttattgacgtttctagttggaatggagacatttcagtagctgaatatcaaaaaattaaaagctatggtgtaacaggtgtttcggttaaattgacagaaggaacttggtatgttaatccatatgctgcgggccaaattagaaatgccaaagctgcgggcttaaaagtttcagcatatcactatagtatgtatgtctctgctgcgacagcacaagatgaagcaagatattttgctcaggcggcggctaactctggcttagataaaaataccataatgtttaatgatgcggaagatccaacgcttacaaacaatgggcgaaacgcccatgctaattctgttgcgtttaaccagcaattaaaggcattagggtataaaaatgatgcgttgtatgttggcaaatggtggttaacaaatggctatatcgacacctccgccttcggaagagacagagtatgggtagcgcaatatccatatactccagatagttccatgcagtggaataatgaccatggtgcttggcaatggtcttcgcaaatgtatttccctggtttagctaattatgaagggcgtccgtttgatatttccatgacctatagtaattttttaaatatgggtaatagtagtgggcctgacttaagtaagtattacacaactaatccaggtcgagtgatcatgaaaaatgacgatactttttaccaagatgtagcgtttagaactcctggttggcgagttaaaaaaaatacactagttaccattaaggggattgaatatagttcagcaggaattcctcgattggtcacagaccaaggttatttaacagcaaataaagattatgtattagcggcacaaagcaatattgatttgtattttacgacaaatcctaaaaaagttcgtttgaaaagcgatgattatttctatgctgatccagaatttaagcaaaggttgtctaaggtttcgaagggaacaatagtagaagttgaagatttagcttatactcaaagcggtatatttcgattgaaaacagcgaaaggatatttgactgcaaataaaaatatagttgaacaatataaaggattagaagatacttactacacatctaatcctggacaagtaattactagaaatgaagatacctattacaaagatgtagaattcaagacaaaagcaaataaagtatctgcaggcagtgttttaaaagtaactgctattgagaaaacaaaatcaggaattcctagattgaagatggcaaatgggtattatttcacggctaacaagaactatgtagtagctactggatcttggattgctaactatcatacggttaatccagggcaaattattatgaaaaatagtgataatttttatggggattcagacttcttatataaaggagcagctgtttccaagggaagtttagttcctgttgtgggaatcgagtaccgtgaaaatcaagttcctcgtttgattacccaaaatggttatttaacggctaataaaagttatgcacaaaaagttgtgccaaacatcaaagattatctatatgattatccagagtatgtagttatgaaaacaaatgattattattatcaagatgtaaatttcagtaaaaaaggtgagtttgtttctaaagatacattaatcaaagttttaagtgttgattataccgaaaacggattacctagattaaagactgccaaaggttatataactgctaacaaatcatatgttacaaaattggtatcaaattcagataattactttactgaaaatccgcaccaaattattatgcgagtgtcagataaactatatactgatgtagagtttcgtaatggtagcagaaccttatcatctgggactgttgttccagttaagggcattgagtattcctctaaaggtgttcctcgcttgaagacagaaggaggatatcttactgcaaataaaaactatgtgacagctgctggaaataccaataacaattactttatcactaatccaaaaaaagttaagctcttaattgatgattgtttctacaataatactgagtttactaaaaaaggacaggctgttaagaagaatacgattgttgaagttgaagcaatcgaatatacaaacaatggtataccaaggttaaagacgaaacaagggtatttaactgctaataagtggtatgtagcaaaagtgggt

SEQ ID NO: 399 - DNA, 4497 bp, Enterococcus faecalis
atgaataaagcagttaaaaattttgtgagttaccttatgattaccatgctgtttattttaaatttgttaccaatgatgaacgcatttgctcaagaagtaacaagtgatgctgagaagactgttgaaaaagacgggctcaaagtaatagggaaaatagaagatacatcgtctcaagaagatattaaaacggtcacttacgaagtaacaaatacgcgagatgtaccaatcaaagatctcattttaaaacaaaaaaataccaatgatagtccaatcaaatttgttttagatactttaagtgaagagcgaggacctacgtctttagaagaacaagcaaaggttgaaacaaatgagaaagatcaaacaaccgatattaaactgcttaaccttcaaccaaattcgacaagaaagattaccataaatgggcaaataactacaaaagcgtcgaacaagttattggtcagcgtactaatagaagataatgaaaaaggaacactagtaattgatttacctagtaaagatatactagcagataaagagtcggtttcgaaggaaaaacaggaaacttcagaaacaaaagtagaaaatcaggcaaacgaaacagcctcttctacaaatgaaatgaccgcaactactagtaacgaaacaaagcctgaagcaggaaaggcgatagaaagtattcaagagacagcactaacgcaggctaccgaaagtcctgagcaacctccattaaaggcgcaacctactggtccgttagtgccaccaacacctggtcgggggtttaatacaccgatttatcaaagcgttcataaaggagaacttttttcaacgggaaataccaacttaaaaattgcgaatgaaaatacggcggctgcacaaacatttttaaacacacgaggagcaagtagtggttatgcaattaacaattttcctttagaatttgcagatgttgacaatgatccaaatacgtataactctagtcgggcttatattgatttaaatggtgcaaaagagattgcttgggcgggcttattttggagtgcatctagatataaaggccctgcttacggaacaaatctttctgatgaagaaattagtgcaccagttcaatttactacaccaaatggaaccgtacagcgtgtttcgccccaaaggtaccatcgtatcgatcaagatgcaacaaacccaggacaacgtttcgggtacaataacactggattttctaattatgcagatgtaacttcaattttacaaggggataaaagtgcgacagggagttatacgttggcagatattcctatgacaagtagtttaaatggtcaatatcaatattataactttagtggttggagtttgtttgttgttacaaaggatcaggcaagtaagtcaagagcttttagtatttactatggagcacgtggtaatgctgctggaaccaataatgaatttactatgagcaactttttaacagcaaaacaaggaaatcttgatccaattgtgacctggtttactgttcaaggagataaatactggactggagacaacgcacaaattaaaaatagcgcaggaacttgggtaaatatttcgaacacgctcaatccagttaacaatgctatgaacgcaactgtgacagataacgatgaacatatggtagacaagtatccagggaaatttgcgccggatcatcctaattttttagatattgatatcgatcgtatggcaattcccgaaggtgttttaaatgctggacaaaaccaaattaattttagaacaacaagtagtggtgacgattattctacgaatgcgattggttttgctgtaaacgcagaaacgcctgaatttgaaattaagaaagaaattgtggaaccaaaagaaacttacaaagttggtgaaacaatcacgtatcgtgtctcactaaaaaatacaaaagctgattctgaagcgataaattcagtctcgaaggatgcactagatggtcgcttaaattatttgccaggctctttaaaaattattagtggaccaaattctggtgaaaaaacggatgcttcaggcgatgatcaagctgaatatgatgaaaccaataaacaaattatagtccgtgtcggcaatggtgcaactgctacacaaggaggtagctacaaagctgatacagctgaaacaatttacgaatttaaagcgcggataaatgaacgagcaaaagcaaatgaattagtgcctaatagcgcaaccgttgaggcagtagatattttaacatctgcaaaagtcaacgaaacttctaatatagtagaagcaaaaattgcggacgaacaagtaactggcaaattaaccgcaacaaaaaccgttaataacgccaaaccaaaactaggggaagaaatcgaatacaccatcagcttccgcaacactatcgaaaacggcatcctaaacaaagtagttatcacagaccaactgccaaaaggactgacatatgtcaaagatagcctaacaagtgttggtgatgaaccaaagccaaccagcttgaaagaaaccaacggcacaatcacagcggaatacccaagtatcaccgatatgaaagaacggagtattcgcttcaaagtgatcgttaacgaagaagccaaagcgggcgaaacaattctcaacaaagccaaagtagatgacacagttaatccaccagaagaaccagaggtgcctgtggtaccagaaacgaacgcaggcaaactagccgcaacaaaaaccgttaataacgctaaaccaaaactaggcgaaactatcgagtacacaattagcttccgcaataccatcgaaaacggcgtcctaaacaaagtagttatcacagaccaactaccaaaaggactgacgtatgtcaaagatagcctaacaagtgtcggtgatgaaccaaaaccaaccagcttgaaagaaatcaacggcacaatcacagcggaatacccaagtatcactgatacaaaagagcggagtattcgtttcaaagtgatcgttaacgaagaagctaaggcaggcgaaacaattctcaacaaagccaaagtagatgacacagttaatccgcccgaagaaccagaggtgcctgtggtaccagaaacgaacgtaggcaaattaaccgcaacaaaaaccgttaataacgccaaaccaaaattaggggaagaaatcgagtacacaatcagcttccgcaacaccatcgaaaacggcgtcctaaacaaagtagttatcacagaccaactaccaaaagggctgacgtatgtcaaagatagcctaacaagtgtcggtgatgaaccaaaaccaaccagcttgaaagaaatcaacggcacaatcacagcggaatacccaagtatcaccgatacaaaagagcggagtattcgtttcaaagtgatcgttaacgaagaagccaaggcaggcgaaacaattctcaacaaagccaaagtagatgacacagttaatccgcccgaagaaccagaggtgccggtggtaccagaagcgaaagaaggcaaattaacagcaacaaaaaccgttaataacgctaaaccaaaactaggggaagcgatcgagtacacaatcagtttccgcaataccatcgaaaacggcgtcctaaacaaagtagttatcacagaccaactaccaaaaggactgacgtatgtcaaagatagcctaacaagtgtcggtgatgaaccaaaaccaaccagcttgacagaagccaatggcacaatcacagcagaatacccaagtatcaccgatatgaaagaacggagtattcgtttcaaagtgatcgttaacgaagaagcgaaagcgggcgaaacaattctcaacaaagccaaagtagatgacacagttaatccgcccgaagaaccagaggtgccggtggtaccagaagcgaaagaaggcaaactagccgcaacaaaaaccgttaataacgccaaaccaaaactaggcgaaactatcgagtacacaattagcttccgcaacaccatcgaaaatggtgtcctaaacaaagtagttatcacagaccaactaccaaaaggactgacgtatgtcaaagatagcctaacaagtgtcggtgatgaaccaaaaccaaccagcttgaaagaagccaacggcacaatcacagcggaatacccaagtatcaccgatacgaaagaacggagtattcgtttcaaagtgatcgttaacgatgaagcgaaagcgggcgaaacaattctcaacaaagccaaagtaggtgatggcatcaatccaccagaagaaccagaagtgcccattacgcctgaagaaccagcgaaaaataaaaaggaaacaaacaaagttgttacagaccagaacaaacctacaaaaaatagtaaaaatgaaattgccataaacaagaaagaaacgtctaaatcatcctatttaccaaaaacaggagaaaaagttcaaaaaatatttgcgtatctgggtgtaggactgatcttaattgtattaattctctatgttataaagagaaacaaagaaaaagaggag

SEQ ID NO: 400 - DNA, 2775 bp, Enterococcus faecalis
gtgagccgggaacggtttcaggcacgggagaaaaaggttcagaagatgggccgggacggtctggtggaacagaaccgcgccaccggcgaagaaaagcgcgtcagccagcgcacggcagacaccgcctttgaccgcgcccgccctacggaacgggaggacatccgccgcccggcagcacggggcgcagacaccggcaaaaagcggaaacagccccgcactgcgccggagatggcggcagaacagacggaaccgctgcttacgccggaatatctggcagacagtactgccgaaccgccgcccgatgccccggcatccatgcgcggcgcggtggatatgccgttactggatgcgcccatagccgaagaacccactcccgcgccggtgaggaaacagccccaaaagcgggggaaaaagggcaagaagaagcaaagcacgaaattcacggaagacgctgcccgaccgggtagtgaggaaaaaacggctatgcgcggtgtggagggcgctcctgccccaaagcggcgcacttctgagggcggctcccgcctgcaatttgacaaggaagaagaaccggcagaccccgcagccgaccgcgcagcaatcagaaagcggcagacagcaaagctggccgaacacgccgccaaaccggaggataagctaaaatccgatggcaatccaaaggccggggaaacacgcctgaaatttgaggacactcccaaagatacggacatttccggcgatactgcgcccgatatgcccacccgccaacaaaagaaatataacaaggccgcctgccgcacggaacgcgcagaccgccgcgtggagcaggcacaaatgaagctgcctgccaaacgccgcctgcacatggatcaccagcctgacgaagccagcgggaagataaagcggcggctccgttttgaggatgaaatcctgccggagtaccaaaagccctccctgtcctcccgtgccggaaatgcggcaaaaacggcggcagtcttaaagctgcatggcaaactccgtgaatatgagcgtgacaacgtggctctggaatctgcccacaaaatcgaactggttgccgaacagggcgcggggcgcgtcctgcgctgggaacggaaccgccgccgctccaaaccctaccgcactttgcggaaagcccagcagaaagcggcgcgggcgcacactgaccttgcatggcagaccgccctgcgggataaccccgaactgcaacgcaaaaacgcgctggcaaaatgggtgcagaagcagaaaatcaagcggaaatatgcccaggccgcccatgaagccaaacagagcgcgaaatttacccaaaacgtcctgaccgccaccggcaagattgcccgcgccatcgcccagtatgcggcggcacataaggcggtctttctggcggttgcaatgctggcgctggtggtgatgttcttcgccacgggcctgacctcctgcaccgccatgctgtcaggcttccagtcctcgtacatttccgcgtcttacatggctaatgagcaggaaatctgccagagcgacctttattacacggaaaaggaaacggatttgcagattgatattgacaaaactgaggaaaattaccccggctatgatgaataccgctacaacatcggtgaaatcagccataacccttatgaactgttaggctacctctccacggcgttcaatgcttttacctttgcagaagtccagcccgaaattgaccgcattttttcccggcagtacaccctcacccgtgaggtgatcgtggaaacccggtatgacgatgacggcgacccttatgactggtatgttttgcagaccacattggccgtgcgcccgctgtcctctgtgttacagagcagcctcacccccggcgaacagaccgaccgctacggcgtgtatatgcagacctacggcaaccggcaggcgtttggaaatccctttggtttttcctggcttggatatgtgagcagcggctacggctggcgggtacaccctgtaaacggcgaaaagagcctgcaccggggcattgacctcgctgtggcgcaggggactccgattctggcggcgcaggacgggcgtgtggtatcggccggcgatgcaggcagctatgggctgtgcgtggtgatcgaggacgataaaggctaccagtcccggtatgcccactgttccagcttaaacgtcagcgccggccaggaagtaaaacgcggggatgtgattgctgctgtcggcagcaccggcaacagcacggggccgcatctccatctggaagtcatgttaaacggcgaatacttgaacccttatttcttcgtggacaatggcgacgatggaaccggcgcaatccccggcacccccggcgggccggctatcccggactattccggcgaaccgatgggcgatggcagctttgaagccatgctgcgggaagcggagaaatacctgggctatccctatgtgtggggcggctcccatccatccacttcctttgactgttccggttatgtttcgtgggtcattaaccagtccggcgtgggcagcgtcgggcggcagacggcacagggcctttacaacctgtgtacgccggtatctgcggtgaacgcacagcccggcgacctgattttctttaccgggacatacagctcgccggggccggtcagccacgttgggatttatgtgggaggcgggcggtttattcactgcggcgacccgatttcctacgccaatacgggaagcccctattggtctgcccatctgtacgggtatggcagaataccc

SEQ ID NO: 401 - DNA, 1182 bp, Enterococcus faecalis
atgacgaataaagagccttgggaggcgtggagtcccgcaaaagttagttcattccaggaagattttttagcttggtatgaacgagaaaaacgcaatttaccttggcgagcgaatacagatgcatatcgtatttggatttctgaaattatgctacaacaaactcgcgtagatacagtcattgattatttttatcgatttatggaatggtttccgacgattcaagatttagcggaagcgccagatgataagttgttgaaagcttgggaagggttaggttactattcacgagcgcgtaatttaaaagtggcagcgcaacagattgtttcagaatttggtgggaaaatgcctgacacaatcgaagatattcggagtttaaaaggaatcggcccctatacggctggtgcgattggcagtattgcctttaatctccgcgaaccagcaattgacggtaacgtcatgcgggtagtgagccgtttatttgaaattgatgcagatattgcaaaagcgagtagtcgtaaagtatttgaagcggcgatgcttaaaatcatcgatcgtgagcgtccaggggattttaatcaagctttaatggatctaggctcagccgtctgcaccccaacttcccctaagtgtgaaagttgtccgcttcagcaatattgtgcggcctatcaggcagataaaatgaccgcttatccagtcaaatcaaaaaaagttaagccgaaagatgtgtattatgtcggcactattattgaaaataaaaagcaagaatttttattagaacaacgccctgaaaccggtttgttagccaatatgtggctgtttccgattgaagaaattagcaaaaaacaatttcaacaattgcaaaaactggcgcaaccagcagaaacggaaaaacaattaactttagagttagagcctgtaacagagcctttggtcgctgaagaacctgtcaacttttttacggactatgaaacagttgtctggcaaaaacgtaccttaggcgaagtcgttcatattttcagtcatttaaaatggcatatcttagtcttttatggccgaaatacaggcgaattagccacactagagtcgcagcgatgggtggcagcacaacaattttcagactatgtttttccaaaaccacagcaaaaaatggtggaattgttcaaaaaagaacacgaaaaaaaa

SEQ ID NO: 402 - DNA, 765 bp, Enterococcus faecalis
gtggaaaagtcaacagttacttctttaactcaagaaacttcagcaacaacaattaatgcttcaactgattcaacagcacttacagctgaaagcgaggaacttccatcgcttcgtcaaacacttcttaattacgtaggtatgtatggtttaacagaaaccttgataaatcgtttatctgatgacgaactggactacgcaaaaaaagtttcgtttcattttgtaaaccaagacatcagtggaacagcgagaatgattactaaattatatggtgagaaacctatcccggaggactcctactctacagattactcaacattaacgattgatgacttaaaaaattatttacctcaaattcgactttcgttaatttatgtatatgatttaaatagtgatgttgtaaataatttaagcgatcaaacactcgtcgatttaattaatcaagtcaaggtagactacgctaaccaaaattacccatctgatgtccgtggtgattatggtttagcagcaatggcagataaaataaaagcaaacgattatacgtcaattaatcaaagtgctgaaagtgtttcttcggatactactaatacagaatctacattacaaacaactacgagcagttcgaagaaagctactacatcaagttcaaccgagcacaaaaaggggatatttcccagtactggcgaaaaaaaatcagttttatttactatcattggaatcatcttactatctttagttagtatattcattataaaaaataaaaagaaa

SEQ ID NO: 403 - DNA, 1299 bp, Enterococcus faecalis
atgaaaaagaaaattttagtaggagcgcttgtcgctctattttttatgcctttaaatgtatttgctgcaaaaggtgaccaaggcgttgactgggcgatttatcaaggcgaacagggtcgttttggttatgcacatgataaattcgccattgctcagattggcggctacaatgctagcggtatttatgaacaatacacatataaaacgcaagtagcaagtgctattgcccaaggtaaacgtgcgcatacctatatttggtatgacacttggggaaacatggacattgcgaaaacaacaatggattactttttgccacgtattcaaacgcctaaaaattccatcgttgcattagattttgaacatggagcgttggctagtgttccagatggatatggaggatatgtaagttcagatgccgaaaaagcagcaaatacagagacaattttgtacggtatgcgcagaataaaacaggctggctatactccaatgtattacagctataagccatttacactaaatcatgtaaactatcaacaaatcatcaaagagtttcctaactctttatggattgctgcgtatcctatcgatggtgtgtcaccatatccattgtatgcttatttcccaagcatggatggtattggcatttggcaattcacatccgcttatattgcaggtggtttagatggtaacgtagatttaacaggaattacggatagtggttatacagatacaaataaaccagaaacggatacgccagcaacagatgcaggcgaagaaattgaaaaaatacctaattctgatgttaaagttggcgataccgtcaaagtgaaatttagtgttgatgcttgggcaactggcgaagctattccagattgggttaaaggaaacagttataaagtgcaagaagcaactggaagcagagtattgctagaaggcattttgtcatggattagcaaaggtgatattgaactattaccagatgcaacagttgtccctgataagcaaccagaaacaacacatatagttcaacatggcgaaacattatcaagcattgcttaccaatacggtaccgattatcaaactttagcttcgttaaatggattggctaatccaaaccttatttaccctggacaagttttgaaagtaaatggatcagcaacaagtaatgtttacacagtccagttgggtgataatttatcaagtatagcggctaaacttggcacgacttatcaaacattggcagctttaaacgaattagcaaatcctaacttgatttatccgggtcaaacgttgaactat

SEQ ID NO: 404 - DNA, 2301 bp, Enterococcus faecalis
gtgtcaaaacaagaatccgatgttgtcttaaattttaagatgaatggagaaataaactattcacgaacaattaaagacattaataaagaaatgaacttagcggctaccgagtacaaaaaccaggtatccgcaatggataaaaatgcaactcaaactgaaaaattaacagctacaaagaaaaaattagaaaaacaattatctttagctgaacaaagaacaaaattattacgtgaggaatacgaaaaatcagtaaaagaaactggtgaatattcagagcaatcacaaaagctgtataagcgtttattggaatccgaaacaggtgaaaataaactgcgttctgcattgcaaagtaccaatgaagctttgaaagagcaaggtaatttatcaataaaaacagctgaaaaactagccaaaattgaaaaagctggagacaaaattaaatcagttgggcaaaaactgtctgttggattaacagcaccaattatgggaattggtgctgcttctattgccgcattcaaagaattagatgaatgtttggataatataacaacagcaacaggggctactggtagtcagctagaatctttacaagccagttttaaaacagtagcaggtcaaatacccgcggatatgcaagatatatcaactggtattggtgaagtaaatactcaatttggcttaatggataagcaattggaagatacaacaggccgaatgcttaaattttcagaaattaatggctcagatgtttctcaatcaactattaatgcaaaaaaatcaatggacctttttaggttgtctattgaggatttgccaatgattttagattcagtatctaaaactagccaagatactggagtaggggtagatcagttatttgatgccgtaaatagaggtgcgccccaactcaaagctatgggacttggtttttctgaatcaactacgttaataggtcaaatggaaaaagctggtattgattcagcaggaactcttggctatttggcaaaagctagtgtcgtatatgcgaaagataataaaaccatgcaagaagggcttagcggaactattgaatctattaaaggggccacaactgaacaagaaaaactcactattgctagtgaagtttttggaactaaagctgcttcaaaaatggtagaagctattgatagcggagcgttgtcaatggatggtttagcagattcagcaaaaaacgcagctggcactgtggatcagacgtttagtgatattcttgatccaattgaccaagcaaagttggcacaaaatcaatttaaaatagcaatgggtgaacttggagaacaagtacaaatagcattattaccagcatttcaagctgcaacggatgcaataaaaaaagtttcagaatggtttggaagtttaacagatagtcaaaagcaaaccatactgaaaatagctggtgttgtggctgctatcggtccagtattagtagttttaggaacacttgctagttccattagtagtttgattccagttattgcttttattgcgtcgccaattggtttagtaattgcggcggttgccgcttgggtagctgcaatcgtagttgcatataataaaatcggttggtttagggattttatcaatacctcctttaaagtaattaaagatattgtggttggtgtatttaatgttttgaaagatacgacaaaatctacttttgatttcatcacaggatttattggtggtgccatggatggggctgcaaaaattattggcgattatgtaaatgaaattaagcgtatttttggcggtatcgttgattttgtaacgggagtatttactggagactggtcaagagcgtggcaaggtgttgttgacatttttggtggtatttttgaaggcatcgctgcagtagctaaagctccaatcaatgccatgattacgttaatcaatggatttattggtggattaaacaatataaaaatacctaaatgggtgccaggaattggcggtaaaggatttcatattggaaaaatcccttatttagcagaaggtggaactattctaaatggccaagccattgttggtgaagctggtcctgaactattaaccgctaaaaacggcaagacaacagtaactccattgtcaccagaagaaaaagctcgtggaattggtggtgctttgaaaggtggcaacactattgagcaacatgttcatattggccaagtagatgcaaataatccgagtgagttagatcgaatgaatcgcaagctttataaagcaagtgcgcaagctttctatgacttaggaggtgttccaacg

SEQ ID NO: 405 - DNA, 1362 bp, Enterococcus faecalis
atgaacaaagaattattgcgtcaattacaagctcgtcacgagaaacgattaagtgatttacaaggcaaaattgaatctggagaagtgcgtgaagcagatttagattcagttaatgaagaaattgatggtttaatcgatgaattaaaagccattaaagctgaattaggggatgataattcagaatctggtgatggtgaaggcgatgacgggaccgctaaatctgataatactgatgatgaaagtaaagaagatcgtgagaaagatacgaacggaaacaacgatgataaaaacgaagaaaatcgtggcggcatgattagccaagaacagcgtgatggtttgttacgcacaattcatgaaggaatggaggctagaaatgtgatgtctaatgaacaacgtgaaaaacaaattcgtaaagcatttgctgattttgttattggtaatatttcagaaagtgaagcacgtgcattaggtattgaaacaggcaatggttcagtgacagtaccagaagtgattgcatccgaagtgatttcttatgctcaagaagaaaacctattgcgtaaatacggaactgtgattcgcacggctggcgatgtgaagtatccaattcttgtgaaaaaagcagaggctaatgtaaacaaaaaagaacgtacgacagatattactgaaacagcgattcaatttgatgaaattctacttgatccagcagaatttgatgcattagcaactgtaacgaaaaaactattaaaaatgtctggtgtgccagtagaagatattgttgtagaagaattgaaaaaagcatatgttcgcaaagaaattaattatatgtttaatggcgacgatgcaggaaatgaaaacccaggagctttagctaaaaaagctgttgcatttgaaaaacctgtagatttaacagctgcaggtgctggtcaaaaattatatgatgcattgattgaatttaaaaatacaccagtaacagaagtaatgaaaaaaggtcgttttattattaatcgtgcagctttaactgctattgaaaaaatgaaaacagatgatggattcccattgttacgaccattcacgcaagcagaaggtggtattggttatcaattagttggttatccagttgattggaccgatgcagcagataaaaaaggtgaaccagatacaccagtattatattttggtgatttttctgctttcaaaattcaagaagttattggagcgttagaaattcaaaaattggttgaaaaattctctggaaaaaatcaagttggtttccaaatttacaacttgttagatggccaattagtttactcaccattcgagccggctgtttatcgttatgaaattacaaaaccagtaggtggt

SEQ ID NO: 406 - DNA, 951 bp, Enterococcus faecalis
atgaaaaagaaatttttagcaatgatggcagtttcaatgatgggactgttaatgttaagtgcttgtcaaacaaataaaaaaacagcagattctgcaacaacagaaacaacagctaaaacggaagtcacagtcaaagacaccaatggtcaattaaccgttcccaaaaatcctaagaaagtcgttgtttttgataatggttccttggatacaatggatgcactaggtgtcggtgaccgcgtggtaggtgcgccaactaaaaatatccctgcgtatttgaaaaaataccaaaaagttgaatcagcaggcggcattaaagaaccagatttagaaaaaatcaatcaactaaaaccagacttaattattatttctggtcgtcaacaagattatcaagaacaattaaaagccattgcgccaaccatttacttagctgtagatgccaaaaatccttgggcatcaacgaaacaaaatatcgaaacgttaggcactatttttgataaagaagaggtagctaaagaaaaaataactggcttagaaaaagaaattgctgacgtgaaaaaacaagcagaagctagcgcgaataatgcgcttgttgtgttagttaacgaaggacaactttccgcttacggaaaaggctctcgtttcggtttaattcatgatacatttggcttcaaagcagcagacgataagattgaagcttccactcatgggcaaagtgtttcttacgaatatgttttagaaaaaaatcctgggattctctttgtggtagatcgcaccaaagcaattggtggcgacgattcaaaagataacgtcgctgcaaacgaattgattcaaaaaaccgatgctggtaaaaatgataaagtcattatgcttcaaccagatgtttggtatctaagcggtggtggattagaatcaatgcatttgatgatagaagatgttaaaaaaggattagag

SEQ ID NO: 407 - DNA, 927 bp, Enterococcus faecalis
atgaaagtgaataaatttgttaaaggttttgcggcaattgcattatcaagtttagtattagcagcatgtggtgcagacaagaaagacaacacaacgaactcttctagcgcagcatcttcagaaacgaaaaaatcaacggaatcatcagcaccagcgaaaaaagttgccggtggcgatttaaaagatggtacgtataaattagaagaaaaaaatgaaaaaaatggttaccgtgcagtctttgaaatgactgtaaaagacggcaaaatcactgaatctaaatatgacaacatcaatgctgacggcaagtctaaaacagaagacactaagtatgaagaaagcatgaaagcaaaatctggtgttggaccaaaagaatacatcaaacaattaaacgattcttttgttaaagcacaaagcgcaagcggtgtggaagtagtaactggtgcgactcattcatctgaatcattccaaaactacgcacaacaattaatccaagcagcacaagctggtaacacagacacaatcgaaatcgacaatggggcaacattgaaagatggtacgtactcattgaaagaaaaaaatgactcaaacggctaccacacaacattctcaatgactgtgaaagatggtaaagtgactgaatctaactacgataacgtgaacgctgacggcaaatctaaaaaagatgacactgaatacgaaagcaaaatgaaagacgttgctggcgttggaccaaaagaatatatcgaaacattaaacaaagaatttgttaaagcaatgggcgaagaagacggatcacctgcaggtgttgaagtagtaactggtgcaacacacagcacacattcattcatcaactacgcacaacaattagtgaacgctgctgaaaaaggcgacacaactgaaatcgttgttgacaacatcgtaacaaaa

SEQ ID NO: 408 - DNA, 753 bp, Enterococcus faecalis
atggactttcaaaatatacaaactgtaaaagaattaagatacgcactgaaacaatacaaacaaacactcgcaactacgatttttgatgatacacaaggctatatcagtgtcgcctttaaaaaagaagtgatagaaaaagacggaaaaaacgttcagtttttatgtttttatcctaattatgaggtcgctctttatccagtcgaaacgttactggcttaccttgaaaagttacctgaacaagcaatcgttacgattaaagaccatgacggtaactactcgtcactttttctaacaattgacgaaacgatagaccaaggaaacaactaccaatggctagtgattagcgacaaaaattcttacgaacgatttttctttacagctcaagaaagcacgcaagaacaagcttttgagaaaatgttaaaagaactagaaaccgaccatgacagtacactagaagttgttcataactggttatgccgacaaacagacgaagcgctttttctaggtattctcaaagaagatagaacgttaaaaggtgctatgacttactgcataggaaaagcccaagaacaatccaaagaccaatcaagcgccatggtggcggacgaagtggttttcagttggataaaagagtatttcttattagagaaattaccagaaaccaaagcagttggtaaagtaacgaccaaaaaatcagaaacaaaacctgaaagaaaagaggtggacgaacaaattgatttgttcgagtgcgta

SEQ ID NO: 409 - DNA, 258 bp, Enterococcus faecalis
atgattattttatcaggactttttattttagggataggaatagttggaggttatcagctagccacgttacctaaattgattgaaatgaaacagcacaaagcaatacagaaccatttcaatgttaaaggaaatgagtacacctattatcaagaagacagtgaaaattacattttatccttggaagatacagaatatcgaattaaattttccaagaacaccccgttaaaagtggtattcactgaaattttagaacctatg

SEQ ID NO: 410 - DNA, 2670 bp, Enterococcus faecalis
atgaaaaagatcgcaagtacagggttaagtattttagtcgcaacaggggtagcaggtattgggggaaatgaagtacaggcagcagaacaagcgcaaccaaaaacacctgaaaacagttctacagaacaaccaacagtgaaagctacacaaacaacggagcaagctattactgaaaaacagcaacaagtaacagagaaacaagcaattgtcgatcaaaaacaacaagtcgctgacactgcgaaaaaagaaaaagacgccattgatcaatctgttaaagaccaacaagcagtggtcgatcaaaacaaagacgcattggatcaaagtcaacaagcagtgactgaccaacaagcagttgtagacgaagctaaaaaagtcgtggatgaagcaacaccttcagccattgaaaaagccaaagagcaagtggctacggatacacaggcagttgatgaccaacaaaaagtagtagatcaagctcaaacagacgttaaccaacaacaagctgttgtcgaagaaaaagcaaaagaaacgaatgctgctaaagtacaaaatgataaagatcaacaagcagtaacagctgcgaaacaagaacaagccaagcttgaagaattagcgaaaaatgcggaagcggaaaaagcaaaggcagaaaaagaacaagcagcaaaagaagctgaactggctaacaaacagaaagaagaagccaaagctaaagatcaaaagacgaaggacgatcaagcagtcgcagaccaacaaagcgttgtgacaactagtcaagagaaagtagcagacgcaaaagcagatacagctgcgaaacaggcagatttaacttcaaaagaaaatgctttaaaagacaagcaagcagcaacaaagcaagcgcagaatactttagatagctcaaaagaagagttaaaggggcataaaggacttaacttacctgctaacttcacacctgattattacaaaaaattaactgaacaagaaaagcaagcaatggaaaaagaagcattagcattaaataaagtttttcctgaaaatcaagcagatgcggcaaaagtaacggaaatgatcaatgtcaaaaatcctaccgaaaaacaaaagcaacaaatgagcgattacgttgtaggacttatcaatgatgttcgcgaaaagcttgggttacaaaagttgaagatttctaaccaagctatgaaatttgcttgggatgtagcaaaatatgataatcccaaagaatttgatcatgacgtaaatgcgatcaatcgtgcagcaaaagaaaatggttttaaagaattccctggacaaaacttttatgaaaacctaagtatgggaagatttacgacacaagaaggtaaagtttctatgtatgactttgaaaaagctgctcgaaatgcacttgtaagcatgttgatgaacgatggacattctggctattcccatttagattctttattagatgcaaatgaaacaaacatggcagtttctatttcaggagatttaaatgatatttcagcaaaaatccatatcattagctataatcaaacaaaattagttgaagcaaatacctatgaagaaggcactgcaccagtctttaagagtaaagaaacccttcaaaaagaagtagcgaccaatcaagaaaaattagctaccgcacaacaagcagaatcagacgcacaacaagcaagaagtgcaagtcagcaagccttaaatacagccaaaacaacacaagcaacagcagaaaaagaactatctgttcataaagcgacattggctaatcttcaagcagttgcgactaagagtacgacaaactatgaagaaaaagtacgacaaactgcggcggcagaaacaaaccttcaacaaacaaaagatcaattggcaacaatcaatgagttaattcagaatcgagctgttgttttagaaaaagcgaaaacaaaagttgcagacgcacaagcgattgaacaaacgtctgctaaagtgctgaaagaaaaacaagaagcccaaaaagcagaagaaaacacattgaatagcttgaaggaagtattggatttagcaaaagaaaacttaaatcaaaaacaagttgcgcttaaaacaagtacacgttcattggctcgtttagaaaatgctcaaccaacatacgaaaaagcagtgaacgagttaaacaaagcagaagcggcagtggtccaagcaaaagaagcctatgaaaattctctgaaatcattggaggaactcaaagaacaacaagccgttgctacacttgcttatacacaagcacaagaagacctttctaatgcgaagttagagctacagcagtaccaaggcatattaagagacttagaggcacaacaagccgaacagcgccgacaagaagcgttgcaagagcaagtagcaaaagagcaacaacgccttgaacgagaagcaaagcaacaacaaatgttagtagcaagtgctacttcagcagataaaacacctggtctccaacagttatctttttctaaacaaaaagaacagccaaaagcacaaacactaacacattcagaacctcgtaagacgaaacaagtagcaaaagcccaagaatccttaccacatacaggagaacaaaaaagtatctggttgactatttttggattattcatggcagtaggtgcgatcagtttcaagaacaaaagacggaaaaatagt

SEQ ID NO: 411 - DNA, 1587 bp, Enterococcus faecalis
gtgttgttagtatttgcaagttgtggagtaaataaatcaacagaagattcaaaaaaaacaaatgaaactaaggtagaacaaatagcaactttatcggcaggtacaccagttcaaagtttagatccagcaacagcagtggatcaaacaagtgttacattgttggccaacgtaatggaagggttgtaccgattagatgaaaaaaatcaaccacaaccagcaattgcagctgggcaaccaaaaatatccaatggtggtaaaacatatacaattgtgattcgagacggtgcaaaatgggccgatggaacagatattactgctgatgattttgtaacggcatggcaaagagttcttgatcctaaaactgcctcgccaaacgtagaactgtttgctgctataaaaaatgcaaaagagattagtatcggaaagcaacaaaaagaaacacttggtgtaaaatctaagggaaacaaaacaatagaaatcgaattagaagaacctacaccttattttacagatttgctagcattgactgcttattttccagtccaacaaaacgcagtaaaagagtacggtaaagaatatggaacaacaaaagaaaacattgtaacgaatggagcatttacattaactgatttaaacggtgttggtatttcagataaatggacgattgctaaaaatccaaaatactgggataagaagcatgtcgccatggaaaaaatcaaatttcaagttgtaaaagacattaatacaggtattaatctctataatgatggtcaactagacgatgcgcctgtagctggggaatatagtaagcaattagaaaataacaaagatttcatacgagaattatctgctacaactatgtttttagaggtaaatcaacgaaataaaaaaagtataacttcaaataaacatgctcgacaagcgattaattttgcgattgatcgtgaggctatatcaaacaagatattaacaaatggaagtataccagctaaaggtgtagtaccgagtaaactagtatataatccaaaaacaggaaaagattttactaattcaagtttagtgtttttggataagagtaaagctaaagacagctgggaaaaagctaaaaaagaattaaaaggtactgatttatctatcgatattatggtcaatgaagaagatttatcaaaaaaactaggtgaatatcttcaaaatgaattgcaagatactttggatggacttaaagtttcagttactgcagtacctgccacgttacaaactgaacgattaaattctgggaactttatgattgcattgagtggttggcaagcagactttgccgatccagttagttttttagcaaattttgagagtaaaagttcattaaatcatggtgggtatgcaaacgaagagtatgataaattgttgaaaaataattcttcaaaaagattgcaagaattgaaggacgccgagaaattaattttagaagatgcgggtgtaataccgttacttcaaattggaaatgctaaattaagaaatcaaaaaatttctgaaatgaaagtacactctattggtgctaagtatgattataaaaccatggagataaaa

SEQ ID NO: 412 - DNA, 855 bp, Enterococcus faecalis
atgaaaaaaattattttatcaagcttgtttagtgcagtactagtattcggtggcggaagtataacagcattcgctgacgatttaggaccaacagatccagcaactccaccaattaccgaaccaactgattctagtgaacctacgaatcctactgagccggtggatcctgcagaaccgccagtaataccaactgatccaacagaaccaagcaagccaaccgagcctacaacaccgagtgagccagaaaagccaacagaaccaacaacgccaattgatcctggaacgccggttgaaccgactgaaccaagcgagccaacagaacctagtcaaccaaccgagcctacaacaccaagcgaaccagaaaaacctgttactccagaacaaccgaaagaaccaactcaaccagtgattccagaaaaaccagcagaaccagaaacaccaaaaactcctgaacagcccactaaaccaatagacgtagtcgttacacctagtggagaaattgataaaacgaatcaatcggcaggaacacaaccaagtattcctattgaaacaagcaacttagcggaggtaacacatgtaccaagtgaaactactccaattacaacagaagctggggaagaaattgtagcagtagataaaggtgttccgttaaccaaaacaccagaaggattaaaaccaattagcagctcgtataaggttttacctagcggaaacgttgaggtaaaagcaagtgatggaaaaatgaaagtattgccacatacaggagagaaattcacactccttttctctgtattgggaagcttctttgtattaatttcaggattctttttctttaaaaagaataagaaaaaagct

SEQ ID NO: 413 - DNA, 2613 bp, Enterococcus faecalis
atggtagaaagtaagcgtacttggaaagaaaaagtacatgttgaatctcaagtagaagagcgtcttagaaaaaatttgaccttaaaatcaagagaagcgacgaagttgcaaaaaaaagcattaaagacgactaaaaaggagtttaaactttctaagaaaaattacaagcaatcactaaaaaaacataaacttaccttgaaaacagggaaggaaccattaagtattaaccatttactggataaaaagaaatttgtagagcaaaagaaacgcaaaaaagcacagaaaattgcttacaaacgaacgaaaaaagtagatgaaacgcgtgtcgttaaccaagtgaaaagggaaaccaaggaagggttgaaaagagaagcgacgcaaaaagtacgaaccacgttaacgcaggaagatacactgaatgaagcaatgaccctttatgaaaaaacacaacaagctaaatttaacatgcgtacagctttgaaaacaggaaaaacggttaagaatctttcggtgaaaactgcaaaagatacgtacggattggggaatcgcttatttaacttttcaagaggacgtgggtttcagcgcacaccaaaagactttacgttaaaaaaacaacttatgaaacaactacggaatcgcgctatgcgctttaaagcagcaaaagaagcgaagaaagccgaacaaggtattggcttgattcgttctttttttaatggtcagaagacattagggaaagtcgctgcattgattctaaaaaatccaatttcttgggttgttttattggttctttttcttgtttttttattgagtggcgttgcaagtagtacacaaaaaccagcgattgttcaagaagaggaagatttaaccgcttcatggacgtattttactaaattagatgcgcaacatacagacgataacaacctgttttatagcaatatcgatgatgttcttttctacatgaattatcggtacgatgattttaaattattagatatggattccactggtacaaagaattttgaaacgattctatctgaactttggacggcactaaacggaaagaaacctgattatcagttgaaaacaatgcaaagtttagagacagataagaaatcgagttattttatcgaagaggaacaagcaaagcattatcaagagataaaaaaagagttaggctaccaaacattggatgatctcctttcttttccagtaaaaactgacgctttaattgtcaataagcgttatggctatgacaaatcaaaagagaagctcaccttatataaaggcattgatgtattgattgaagataatcagccgtttcattcaccaatgaacggccaaatcgtttcagtgcctgatacagaaacgctggttatcgaaaaagagaaagtagctaggttaacgattcgtggtgtgaatacccttcgactaacaaaaggtatggatgttgaagaaggaacatttcttgggaatacaaagaattcaacagttacgttccaatatgaaaaatataaaaaagaaacgaaagactggttttttgtaaatccagccttttattttccacgtgtaacctacacgcaaacgactcttttaggaagtgcagaattttctcctggagcaagtgtcgaaaaaagagcgcaagctgtttatgattatttatcaaaaaagggatacaccaaagagggaattagcgcgattttaggcaatttttcggtagaaagtggcattaatccaaaacgtgcagaaggggattatttgaatccgcctgtaggtgcgcatgggaattcatgggacgaaccgagttggcttgctatgggaggaccgcaaatttatggaggacgttttccaaatattctccatcgaggactaggtttaggtcagtggacggatacagctgatggtggtcgtaggcatactttgttattagactatgccaaaggtaaaaataaaaaatggtacgatctgcaattgcaactggactttatttttgacggcgatgcaccaggttcacgaacagcagcagacaatgtagcaagaagtaaggtggctgcaactattccagaacttactacttattatctaactgtttgggaaggaaatcccggagacaagttaggagaacgaattcaagctgcacaaaattggtttacattcttttctcgatcgggtacaccaatcggtggttctgggagtgaggtctttgcgcagtataaagaaaaaatgcaaccattacccacagacagagaaacaaaagcaggacaaggctggccaggcaatgcgtatgcgccagggaattgtacttggtatgtgtttaatcgttttgcacagttaggaaaaagcatttaccctactatgggaaacgccaatcaatgggtgcataactacagtcaaacgcccggagcgacacttgaatcggcccctaaaaaaggggatgctgttatttttacaaatggtgtagctggttctagtacgcaatatggacacgtggcttatgtggagcatgtaaactctgatggtagttttgtcatttctgaaatgaatgtcagtggtgagtattctatgaattggcgtgtcttaaaaaaagaagcaggcgaatactttatgcgcctaaac

SEQ ID NO: 414 - DNA, 1170 bp, Enterococcus faecalis
atgacccaagtacattttacactgaaaagcgaagagattcaaagcattattgaatattctgtaaaggatgacgtttctaaaaatattttaacaacggtatttaatcaactaatggaaaatcaacgaacagaatatattcaagcaaaagaatatgaacgaacagaaaaccgacaaagtcaacgaaatggctattatgagcgcagctttacgacacgtgtaggcacgctagaattaaaagtacccagaacacgtgatggccatttttcacccacagtgtttgaacgttatcaacgaaacgaaaaagccctcatggcttcaatgttggaaatgtatgtatcaggcgtttcaactcgtaaagtatcaaaaattgtggaagaactttgtggtaaatccgtctctaagtccttcgtttctagcttaacagaacagctagaacctatggttaacgagtggcagaatcgtttattatcagaaaaaaattatccttacttaatgaccgatgtactctatataaaagtacgagaagaaaatcgagtactctcaaaaagctgtcatatagcgattggaataaccaaagatggcgaccgtgaaattatcggcttcatgattcaaagtggcgaaagcgaagagacctggacaacattttttgaatacctaaaagaacgcggtttacaaggtacggaactcgttatttctgatgcgcacaaaggattagtctctgccattagaaaatccttcaccaacgtaagttggcaaagatgccaagttcacttcctaagaaatatctttaccaccattcctaaaaaaaattcaaaatctttcagagaagctgttaaaggaatttttaagttcacagatattaacttagcgcgtgaggctaaaaatcgattgattcatgattatatcgatcaaccaaaatattcaaaagcttgcgcatcattggatgatggattcgaagacgcctttcaatataccgtacaaggaaattcccacaatcgactaaagagtaccaatctaattgaacgactgaatcaagaagtacgcagaagagaaaagattattcgcatcttccccaatcaaacatcagccaatcgcttaattggagccgttcttatggacctacatgatgaatggatttattcttcaagaaaatacatcaattttgataag

SEQ ID NO: 415 - DNA, 87 bp, Enterococcus faecalis; identical to SEQ ID NO: 97

SEQ ID NO: 416 - DNA, 213 bp, Enterococcus faecalis; identical to SEQ ID NO: 98

SEQ ID NO: 417 - DNA, 105 bp, Enterococcus faecalis
ctcaataaaagggcttgcgaaagtagaagctgtttacgatcaagaaatccaagaggtaagagaaacgtacaatgcgattattgcaaatgtagaaagagtgcctgc

SEQ ID NO: 418 - DNA, 132 bp, Enterococcus faecalis
gtgcctacattgcttacaaaccaactgtcggtatgccagaagcacggcggacagttatttcaaatattcacaaaggtgggacaccggctgttgaagcaggggcctacattgccgaaattattaaaaaaatgt

SEQ ID NO: 419 - DNA, 78 bp, Enterococcus faecalis
aagcggctgcaaaaaaagctgaaaaagtctatctcgcagccgatccggaccgagaaggtgaagcaattgcttggcatt

SEQ ID NO: 420 - DNA, 126 bp, Enterococcus faecalis
atggcattgttacctaatgtcacaagtaaaccagcccacggtgttgccattcctgtcacaggtacttttaagccaaagaaggtcactacaatgccactaaccattcctgaaaataaattcgttgcg

SEQ ID NO: 421 - DNA, 180 bp, Enterococcus faecalis
agttgcgcattttgccacgtttctttcgttggcaaatattttcgtagtccagctactggtacgaccacgattcctgcattcgctgtcatcaggaaatttaacgcactcactcgatctgcgcgcgcttctggtgaagaaaaggccatttcggcggataacacttcatctactggaaataga

SEQ ID NO: 422 - DNA, 72 bp, Enterococcus faecalis
ggaagcatcgtagataattcaccagatatcaatgcgattggaccagcaaagaataagaccgcgaaaattgtg

SEQ ID NO: 423 - DNA, 132 bp, Enterococcus faecalis
agccaggggcaatgttatggccaattaatgctgcttcaatacaaattgttccagaaccacaaactggatcataaaaaggacgatctttgcgccaattggtcaacatcactaaagcagctgccatgttttcct

SEQ ID NO: 424 - DNA, 402 bp, Enterococcus faecalis
tcattcgtccagtcctcctactgttcttcgctacgtgcgttttccggtaaaattaaattcaaaacaattcctaagacagttgctaatgccattgaagacaattcaaaagttcctactttgaagactaagccaccaatgccgatgactaaaattactgaagcaatcaataaattctttttcttatcaaaattaatcttattatcgattaagattttcaaaccacttgcggcaatcacaccgaacaagacgaaactaattcctgaaataactggtcctgggatacttagaatcaaggcacttaattttccaacaaagcctaaagctacagcgaacaccgcggctccaccaatcacgaagacactgtgtactcttgtaattgctagcacgccgatattttcacca

SEQ ID NO: 425 - protein, 188 aa, Enterococcus faecalis
MINNVVLVGRLTKDPDLRYTASGSAVATFTLAVNRNFTNQNGDREADFINCVIWRKPAETMANYARKGTLLGVVGRIQTRNYENQQGQRVYVTEVVCENFQLLESRSASEQRGTGGGSFNNNENGYQSQNRSFGNNNASSGFNNNNNSFNPSSSQSQNNNGMPDFDKDSDPFGGSGSSIDISDDDLPF

SEQ ID NO: 426 - protein, 522 aa, Enterococcus faecalis
MAVKKKKATFWEFFQGLGKTFMLPVALLAFMGILLGLGSSFSSESMIETIPFLGKPAVKIIFQFMSTIGGFAFAYLPVMFAMAIPLGLVRKEKGIAAFSGFVGYTVMNLAINFYLVQTNRLVDPEQLREAGQGMVFGIQTIEMGVLGGIIAGLIVYKLHNRFYTVQLPDSFAFFSGARFVPIITSLVMAFVGLVIPLVWPLFALMIMAIGQLIQRSGIFGPFLFGSGERLLLPFGLHHILVSMIRFTEAGGSAVVAGKEVFGALNIFYAELQNNLPISPSATAFLSQGKMPTFIFGLPAASLAMYHTAAPANRHKIKGLLLSGVIATAITGITEPIEFLFLFISPLLWLFHVIMTGLGFMVMALLGVVIGNTDGGLLDFVIFGLLQGTYTKWWWVLIVGAIWFVVYYFVFKTVIVTFDLKTPGRDKVLDETEYTDQEVQYKKTGGYDAPGILAALGGQENIQAIDNCITRLRLVLADANKVDDDKLKQLGALGVVHLDAQNVQVIIGTKVTTVRNQLEMILG

SEQ ID NO: 427 - protein, 901 aa, Enterococcus faecalis
MKKIASAGLSILVATGVAGIGGNEVQAAEQAQPKTPENSSTEQPAVKATETTEQAITEKQQQVTEKQAIVDQKQQVADTAKKEKDTIDQSVKDQQAVVDQNKGALDQSQQAVTDQQAVVDEAKKVVDEATPSAIEKAKNQVATDTQAVDDQQKVVDQAQADVNQQQAVVEEKAKETNAAKVQNDKDQQAVTAAKQEQAKLEELAKNAEVEKAKAEKEQAAKEAELANKQKEEAKAKDQKTKDDQAVADQQTVVTTSQEKVADAKADTAAKQADLTAKENALKDKQTATKQVQNTLDKSKEELKGHKGINLPANFTPDYYKKLSEQEKQAMEKEALALNKVFPENQADVAKATEMINVKNPTGKQKQQMSDYVVGLINDVREKLGLQKLKISNQAMRFAWDVAKYDNPKEFDHDVNAINRAAKENGFKEYPGQNFYENLSMGYFETINGTISQLEFEKAARKTIADMLFDDESSAYSHIDSLLKGDTTNMAVSISGDLNDISAKIHIISYNQSKLVEANTYEEGTAPVFKSKETLQKEVATNQEKLATAQQAESDAQQAKSASQQVLNTAKTTQATAEKELSVHKATLASLQAVATKSTTNYEEKVRQTATAEKSLQQTKDQLATINELIQNRAAVLEKAKTNVSEAQAIEQTSAKVLKEKQAAQKAEENTLNSLKEVLNLAKENLNQKQVAFKTSTRSLSRLENAQPTYEKALNELNKAEAAAVQAQEAYENSLKSLEELKEQQAVATLAYTQAQEDLSNAKLELQQYQGVLRELEAQQAEQQRQEALQEQVAKEQQRLEREAKQSQTLVASATSADKTPGLQQLSFSKQKEQPKAQALTHSESRKTKQVAKAPDSLPHTGEKNNKWLAIAGLIFALLGAAGIISFISRNEKKVKNIFKIK

SEQ ID NO: 428 - protein, 282 aa, Enterococcus faecalis
MKKMIIIALFSTSLLAGGSSVSAYAQESEGNLGETTGSVLPDEPNVPTDPITPSEPEQPTEPSTPEQPSEPSTPTEPSEPSKPTDPSLPDEPSVPTEPTTPSKPEQPTEPTTPSVPEQPTEPSVPEKPVEPNKPTEPEKPVPVVPEKPVVPQQPEQPTDVVVKPNGEIATGESTQQPTVPIETNNLSEVTHVPTVTTPIETASGEAIVAVDKGVPLTQTADGLKPIKSEYKVLPSGNVQVKSADGKMKVLPYTGEKMGIIGSIAGVCLTVLSGILIYKKRKV

SEQ ID NO: 429 - protein, 449 aa, Enterococcus faecalis
VKKRLFASVLLCSLTLSAIATPSIALADNVDKKIEEKNQEISSLKAKQGDLASQVSSLEAEVSSVFDESMALREQKQTLKAKSEQLQQEITNLNQRIEKRNEAIKNQARDVQVNGQSTTMLDAVLDADSVADAISRVQAVSTIVSANNDLMQQQKEDKQAVVDKKAENEKKVKQLEATEAELETKRQDLLSKQSELNVMKASLALEQSSAESSKAGLEKQKAAAEAEQARLAAEQKAAAEKAKQAAAKPAKAEVKAEAPVASSSTTEAQAPASSSSATESSTQQTTETTTPSTDNSATENTGSSSSEQPVQPTTPSDNGNNGGQTGGGTVTPTPEPTPAPSADPTINALNVLRQSLGLRPVVWDAGLAASATARAAQVEAGGIPNDHWSRGDEVIAIMWAPGNSVIMAWYNETNMVTASGSGHRDWEINPGITRVGFGYSGSTIVGHSA

SEQ ID NO: 430 - protein, 199 aa, Enterococcus faecalis
MKSIKTILLGTTLAAGLGLFLGTDANAESLYTVKAGDTLSTISHQFAGDNSLIQKIASDNKLPNLDLIFEGEQLVIRSEKEVANTPAPAVEVAPVQQVVEQPVAQPVQQEVQQPVAQEVAQPAAPAASSDAKEWIAQRESSGSYDATNGQYIGRYQLSASYLNGDYSPANQERVADQYVAGRYGSWDAAKSFWLANGWY

SEQ ID NO: 431 - protein, 676 aa, Enterococcus faecalis
MKKIYQWAVGQSFKKLDPRQQVKNPVMFVVYLGALITTILCFYPMGIPLWFNISITIFLWLTLLFANFAEAVAEGRGKAQADSLKQAKKEVMTYKINSLEDIKEENFIELQSSDLKRNDLVYVRAGEQIPADGDVIEGAASVDESAITGESAPVIRESGGDRSAVTGGTTVVSDYLVIRVTSENGQSFLDKMIAMVEGTQRKKTPNEIGLQIFLITLTIIFLTVSITLVPFTDFSSQLSGKGEALSLVIVIALLICLAPTTIGALISSIGIAGMSRLTKENVIAMSGRAIEAAGDVDVLLLDKTGTITLGNRRASDFLPVHGVSEEQLADAAQLSSLADETAEGRSIVILAKERFNLREREFQQSEVKFIDFSAKTRMSGIDYRGDVIRKGAADTMKKYVQSKGEDYPSECDKIVDKIARAGGTPLVVIKNNRVMGVVYLKDIVKNGVKEKFADMRKMGIKTIMITGDNPLTAAAIAAEAGVDDFLAEATPENKMNLIREYQEKGHLVAMTGDGTNDAPALAQADVAMAMNTGTQAAKEAGNMIDLDSSPTKLLQVVQIGKQLLMTRGALTTFSIANDIAKYFAVIPVLFYSIYPQLDRLNIMGLGSPLTAILSAVIYNAVVIVALIPLALKGVRYQEKPASQILSHNLLIYGLGGIIAPFIFIKIIDLILSLIIL

SEQ ID NO: 432 - protein, 1569 aa, Enterococcus faecalis
MFFTGKERNLKFAIKKKHGGGGAASVIIGCIIFGSIAFGGTTLAYADEVHNSINQDIQDSGSTIIGENDSSTKSAEYKMIHEIDGTKISNGENSKETTTSSGTILAEEAIESSNQKNSKTSEVEQDLHKDVSGSESVKQVETSDSIKKSEESAVKTLNLDDSQENTNSITTKAENDALSTVNDEKVLNESDSIIKSIPSETENVDNNSKSDNRDLVENSVETTKEIMKEADKTEIAKRNDNISVLNAGTESFNDSDKIRRSKRDNESPVPSLSIQMPVTKEIYENDSTIKGKSEPGVTIKIYKNGIELGSIKADDDGNFEYPLESQAIKSDNYSFVAEKDGAKSIESSVNVVENKEIVGNQRDAYTPYGFGIYNRGLVTTDDGKKHYTVDMEGNLASEAYFDLAGGTMYYSIDEKFAPYVEKIVLDGKTIISKNPYELPNKTNIWSSGILSTDKRGGLVRAALVGRTNGTIDIYFKDDTPQEVLNSEIPFQVWARFKEKKEGVKNDLISDFDLNILLQNNKLILSKDTFFKDEDIVNNNGPKISSNFNYTNNTIDINYGVNTGNYGLTIGKRSPYNLHINTGKELSDLVDTIKIDNKNYEFEKLPDGSLVIKDIYKKGILGGALLNRQEITISLGLIAKKNLGDLIDFKQELLKLDVSIRDNTTFKLVKGEATEAIRKIDSSFDTFKQELTKWIEKRDSNPQEPITINSGDNTSIVDPKEMVEFAVKNPTTENINKARSLVSKMWLWDKNKYNPVLNAAEEVNRYLSTTLNGSSNDDGLILNNTHAATFVKLIDTDKDGILDRYEANMGIGTNYTNADSDGDGKSDGFEIFNDTDPLVSPYDWFDKNGEKIKIVTTDTDTISGRIGNNNYDTENVYPRTVQLIKVTDNGENLISEISSSEDRKGTFEFTGLSGKLSKGDRLVVKIITNEVQREIDRQRNVVQVGYDNPEVSEEVIVQGAQVTVSFDFNYNQTDPDFDRQPVTQVVELEKGSRLLNSYFTPERKGYKFIGWNTDKLGVGQTVNDGSSFNEDITVFAQWEKEPNLAGEVHAPQGPIEEGKSIVLNNVVQSNKSGSVIVTGELPKGLFGLSINETGNLIGTPLINDWIDGENSREVKIPVTISNGDEKVMVEVPLTILHDTRAADAVKAAEDAGKAGADKKAEVETDGLVTPEEKAAVDGLNDTTTAKKEDASKLVDALPEGPVKDSLKDRLDKVTTSEVTVNDADSNGKADDVDLAEKAAADAVKAAEDAGKAGADKKAEVETDGLVTPEEKAAVDGLNDTTTAKKEDASKLVDALPEGPVKDSLKDRLDKVTTSEVTVNDADSNGKADDVDLAEKAAADAVKAAEDAGKAGADKKAEVETDGLVTPEEKAAVDGLNDTTTAKKEDASKLVDALPEGPVKDSLKDRLDKVTTSEVTVNDADSNGKADDVDLAEKAAADAVKAAEDAGKAGADKKAEVETDGLVTPEEKAAVDGLNDTTTAKKEDASKLVDALPEGPVKDSLKDRLDKVTTSEVTVNDADSNGKADDVDLAEKAAADAVKAAEDAGKAGADKKAEVETDGLVTPEEKAAVMA

SEQ ID NO: 433 - protein, 533 aa, Enterococcus faecalis
  MISC_FEATURE (54)..(54): "n or x" represents undefined/missing nucleotides or amino acides due to unavailable sequencing information..
LPEGPVKDSLKDRLDKVTTSEVTVNDADSNGKADDVDLAEKAAADAVKAAEDAXKAGADKKAEVETDGLVTPEEKAAVDGLNDTTTAKKEDASKLVDALPEGPVKDSLKDRLDKVTTSEVTVNDADSNGKADDVDLAEKAAADAVKAAEDAGKAGADKKAEVETDGLVTPEEKAAVDGLNDTTTAKKEDASKLVDALPEGPVKDSLKDRLDKVTTSEVTVNDADSNGKADDVDLAEKAAADAVKAAEDAGKAGADKKAEVETDGLVTPEEKAAVDGLNDTTTAKKEDASKLVDALPEGPVKDSLKDRLDKVTTSEVTVNDADSNGKADDVDLAEKAAADAVKAAEDAGKAGADKKAEVETDGLVTPEEKAAVDGLNDTTTAKKEDASKLVDALPEGPVKDSLKDRLDKVTTSEVTVNDADSNGKADDVDLAEKAAADAVKAAEDAGKAGADKKAEVETDGLVTPEEKAAVDGLLEIKQSSFMPFENLFSTTNDYSQFPKTGEKSDSILTIYGGLLFLSSIGLLGIKKRKNNTN

SEQ ID NO: 434 - protein, 466 aa, Enterococcus faecalis
MKRKINYTHIAEPTVFENVFPTYLTNETMMARKQKVLQRMETEKFDQLVFYADKEHGSNFEYLTGFIPRFEEGLLVLNKDGAATLILGNENLKLCQHARISADLIHYLAFSLPNQPMAGEQKLSQIFETLLDETAQKIGIVGWKMFTTQQQEPATMFDVPHFIVEALKKALPKEARLLNGTHLLIGAKGARATNNANELAHYEYGANLASRSMLKALNAIEIGQRETDIGALLNDEGQTPTVVTIAATGQRFEYANMYPTAKEIQLGDALSLTTGYKGGLSSRTGFVIENEQQLPEAQRDYLERVAKPYFQAVVHWLETIRIGLLGREMYQAIEEQLPKEIYHWHLNPGHLVSDDEWMSSPIYPDSAIRLESGMLFQVDIIPSVPGYTGVSAEECVALADETLQKEIQQTYPDMWQRIATRKAYLKETLKLDLPSEVLPMSNLVGYLRPFYLAKDKALCVEKPALK

SEQ ID NO: 435 - protein, 362 aa, Enterococcus faecalis
MKKARVIYNPTSGKELIKKNLADILSILEECGYEASAFATTPEENSARNEAHRAARAGFDLLVAAGGDGTINEVVNGIAPLKRRPKMAIIPAGTTNDYARALKIPRDNIVKAAEVIKKNQTVKMDIGQAGKNYFINIAAGGHLTELTYEVPSELKSIFGYLAYLAKGAEMLPRVKPIKMRMTYDEGVYEGNASMFFLGLTNSVGGFEQIVPDAKLDDGKFSLIIVKTANIFEILHLVALMLNGGKHVEDHRLIYTKTSYLHAETLEKNNKMMINLDGEYGGDAPMTFKNMHQHIEIFANGDALPSNAIMGSVLTGSDEIVVESEDEEEEAYNEASKEFVKEVERLTDEDIDGDGKIAEKEKH

SEQ ID NO: 436 - protein, 921 aa, Enterococcus faecalis
MTNTVKVKDDSLADCKRILEGQATFPVQAGETEPVDLVVVEDASGSFSDNFPHVRQAIDEVVQGLSDQDRVMLASYRGGKQFMFPDGKTKINSADYDMNVRVNTQLTYDKSQFVSGFGDVRTYGGTPTAPGLKLALDTYNQTHGDLTNRKTYFLLVTDGVANTRLDGYLHKTNTNDSINEYPDPRHPLQVSVEYSNDYQGAAAEVLALNQEITNQGYEMINAYWESVESLSSVNSYFDKYKTEVGPFVKQELQQGSSTPEDFITSQSIDDFTTQLKQIVKDRLAQSTPATASLTIANQFDIQSATATDDAGNDVPVQINGQTISATSTEGYVGNITIHYEVKENTAIDAATLVSSGTMNQGTIAKEFPEATIPKNDNAHACDVTPEDPTITKDIENQEHLDLTNREDSFDWHVKTAFGNETSTWTQASMVDDINKVLDIIDVKVTDENGKDVTANGTVTQENNKVTFEMNKQADSYDYLSGHTYTMTITTKIKTDATDEELAPYIEQGGIPNQADLNFGNEGDVLHSNKPTVTPPPVDPNIAKDVEGQEHLDLTNRDQEFKWNVKTAFGNETSTWTQASMVDDINKVLDITDVKVTDENGKDVTANGKVTQENNKVTFEMNKQADSYDYLSGHTYTMTITTKIKASATDEELAPYIEQGGIPNQADLNFGNEGDVLHSNKPTVTPPAPTPEDPTITKDIEGQEHLDLTNRDQEFKWNVKTAFGNETSTWTQASMVDDINKVLDITDVKVTDENGKDVTDNGIVTQENNKVTFTMNKKDDSYSYLAGHTYTMTITTKIKTDATDEELAPYIEQGGIPNQADLNFGNEGDVLHSNKPTVTPPAPTPEDPKKPEPKQPLKPKKPLTPTNHQAPTNPVNFGKSASKGIHLPMTNTTVNPLYMIAGLIVLIVAISFGITKNKKRKN

SEQ ID NO: 437 - protein, 595 aa, Enterococcus faecalis
MSAWQTFKNGTRQFFKDILQYLWLFFTLNVLLLLVGGAFSWATSNALKTQGIPYLSFNNLNLLLEKPLALVLLILLLLLFLGAVFYQFTFLLLGIFQIRQDHRFHFKGVTKASFKVLKKQGARSWLFFFGYFVVIVPFGNLIFQSNLLTKFVIPDFIVEFLSQRIPYLVGLLAFGLLVWYLAIRFIYTLPLMILERKKAGEAVKASWSMTNKRLWFIIRNIAFVTIAVFVSTYVIYVLLYLLQLKLDTLSDTISLLGGILNLTVVQFLQFVSNAWLSVLLINFLYTQLNVQAETTTKVAFDKETKRNKLVTIGMGLGLFTIFGGYIIFNAVYLTGLLESKPLIISHRGVTNSNGVQNTIPAMERTIKFKPDYIEIDVQETKDHQFVVMHDANLQELAGVDGTPQEFTLAELTKMTVKENGQEAPIASFDDYLAKANQAKQKLLVEIKTSKQDSQGALSNFIEKYERPLIKNNHQVQSLDYNVIKAFKKAKSKVKVSFILPYNFTFPETQADLYTMEATTLNDTFILKADQQKKAVYAWTVNDSEVLSKMLFMDVAGVITDDLELVNEEVNDFEKNPSYADRILHYIFMLPSVASQ

SEQ ID NO: 438 - protein, 1103 aa, Enterococcus faecalis
MITDENDKTNINIELNLLNQTEQPLQREIQLKNAQFMDTAVIEKDGYSYQVTNGTLYLTLDAQVKKPVQLSLAVEQSSLQTAQPPKLLYENNEYDVSVTSEKITVEDSAKESTEPEKITVPENTKETNKNDSAPEKTEQPTATEEVTNPFAEARMAPATLRANLALPLIAPQYTTDNSGTYPTANWQPTGNQNVLNHQGNKDGSAQWDGQTSWNGDPTNRTNSYIEYGGTGDQADYAIRKYARETTTPGLFDVYLNVRGNVQKEITPLDLVLVVDWSGSMNENNRIGEVQKGVNRFVDTLADSGITNNINMGYVGYSSDGYNNNAIQMGPFDTVKNPIKNITPSSTRGGTFTQKALRDAGDMLATPNGHKKVIVLLTDGVPTFSYKVSRVQTEADGRFYGTQFTNRQDQPGSTSYISGSYNAPDQNNINKRINSTFIATIGEAMVLKQRGIEIHGLGIQLQSDPRANLSKQQVEDKMREMVSADENGDLYYESADYAPDISDYLAKKAVQISGTVVNGKVVDPIAEPFKYEPNTLSMKSVGPVQVQTLPEVSLTGATINSNEIYLGKGQEIQIHYQVRIQTESENFKPDFWYQMNGRTTFQPLATAPEKVDFGVPSGKAPGVKLNVKKIWEEYDQDPTSRPDNVIYEISRKQVTDTANWQTGYIKLSKPENDTSNSWERKNVTQLSKTADESYQEVLGLPQYNNQGQAFNYQTTRELAVPGYSQEKIDDTTWKNTKQFKPLDLKVIKNSSSGEKNLVGAVFELSGKNVQTTLVDNKDGSYSLPKDVRLQKGERYTLTEVKAPAGHELGKKTTWQIEVSEQGKVSIDGQEVTTTNQVIPLEIENKFSSLPIRIRKYTMQNGKQVNLAEATFALQRKNAQGSYQTVATQKTDTTGLSYFKISEPGEYRMVEQSGPLGYDTLAGNYEFTVDKYGKIHYAGKNIEENAPEWTLTHQNNLKPFDLTVNKKADNQTPLKGAKFRLTGPDTDIELPKDGKETDTFVFENLKPGKYVLTETFTPEGYQGLKEPIELIIREDGSVTIDGEKVADVLISGEKNNQITLDVTNQAKVPLPETGGIGRLWFYLIAISTFVIAGVYLFIRRPEGSV

SEQ ID NO: 439 - protein, 488 aa, Enterococcus faecalis
MGILLPIIIAVLVLLMLLIVFVSKYQTAKPDEALIISGSYLGSKNVHVDEGGNKIKIVRGGGAFVLPVFQRSNRISLLSSKLDVSTPEVYTEQGVPVMCDGTSIIKIGSSVEEIATAAEQFLGKTTEELENEAREVLEGHLRSILGSMTVEEIYQNRDFSQSVQEVASVDLAKMGLVIVSFTIKEVRDKNGYLDSLGKPRIAQVKRDADIAEAEALKETRIKKAEAEKESQQAELQRQTEIAEASKEKELKLALYKQEQDIAKAKADQAYNLESARAQQHVVEQEMEVKVVERQKQIELEEKEITRREKQYDSEVKKKADADRYAREQEALAQKAREVAEAEAERFKVEALAEAEANKTRLTGQAQAEAILARGAAEAEAKQKIADAFKEYGEAAVLSMVMEMLPQLMKEAAQPLGNIDKISVVDTGAGGENSGANRITNYATNLLAGTQETLKETTGLDVKELIENFSKKGTSNSVNYHATEGSEKE

SEQ ID NO: 440 - protein, 539 aa, Enterococcus faecalis
MAYQFKLPDIGEGIAEGEIVKWFVKPGDTINEDDTLLEVQNDKSVEEIPSPVTGTVKNIVVPEGTVANVGDVLIEIDAPGHEDNDAAPAAPAQEQTPAQPAAVPTTEAAGGFFQFKLPDIGEGIAEGEIVKWFVKAGDTINEDDSLLEVQNDKSVEEIPSPVTGTVKNIVVPEGTVANVGDVLVEIDAPGHNSAAPSVAAPATDAPKAEASAPAASTGVVAAADPNKRVLAMPSVRQYAREKDVDITQVTATGKGGRVIKADIDAFVSGGSQAAPATEAAATEAAPKAEAAAPKAAPKAFTSDLGEMETREKMTPTRKAIAKAMVNSKHTAPHVTLHDEVEVSKLWDHRKKFKDVAAANGTKLTFLPYVVKALTSTVQKFPILNASIDDAAQEIVYKNYFNIGIATDTDHGLYVPNVKNANTKSMFAIADEINEKAALAIEGKLTAQDMRDGTITISNIGSVGGGWFTPVINYPEVAILGVGTIAQEPVVNADGEIVVGRMMKLSLSFDHRIVDGATAQKAMNNIKRLLADPELLLMEG

SEQ ID NO: 441 - protein, 250 aa, Enterococcus faecalis
MEYTIKKMASLSGVSARTLRYYDEIGLLQPARINSSGYRIYGQAEVNRLQQILFYRELDLKLDEIKEILEQPDFNVEQALYEHQQKLLEKRNEIDRLLASVQQTLHHYKGEINMSDQQKFEAFKQQKVQENEEKYGKEIREKYGNETIEQANKKYLNLTEKDMQAMQNVEKDLFSKLAMYQKSPKLTSQLAQEIFQLHKDWLMYSWSSYSPEAHKGLGLMYVGDERFTSYYEQHGAGFAEALNAIIQNYA

SEQ ID NO: 442 - protein, 195 aa, Enterococcus faecalis
MAKKGGFFLGAVIGGTAAAVAALLLAPKSGKELRDDLSNQTDDLKNKAQDYTDYAVQKGTELTEIAKQKAGVLSDQASDLAGSVKEKTKDSLDKAQGVSGDMLDNFKKQTGDLSDQFKKAADDAQDHAEDLGEIAEDAAEDIYIDVKDSAAAAKETVSAGVDEAKETTKDVPEKAAEAKEDVKDAAKDVKKEFKG

SEQ ID NO: 443 - protein, 107 aa, Enterococcus faecalis
MKRKLTKSPNNVVLTGSLAGIADWLGIDPTIIRVVYVLLSFFSAGFPGILLYIALAVLIPSGRTGSDRGYGHQNPYNRNVRNENPYAANKKQRKEAEKIDDDEWSDF

SEQ ID NO: 444 - protein, 533 aa, Enterococcus faecalis
MKERERVLELVKKGILTSEEALILLENMATEKDEKQIEKAAEKVDTQNIGTTNKEDQVADLMNALEKGESEGPTVDSFEENTQDSAEKDRENLERILDELATKANRASAELDEVNAEIAGIKEEIKEVAEEIGTLDTKEELDALTEDEQVQRKDLHVLLAQLEEKLATQSTEKTALEEELKNIRKEQWKGQWNDTKEKVSSQFSEEWKDQATDTFNQVGGKVAEVGGQVGEFLKKTFNSFSDTMNDNVEWKDIKMKVPGVATTKFEHEFNYPNPQASLIDVKVANGTVVFKTWDQEDVKVEAKIKLYGKMAGDSPMEAFLERSDIDVDDETISFQVPNKRVKADLTFYLPKRTYDHVSVKLLNGNVLVEELTAKDVYTKSTNGTITFKKIDATMLEIEGVNGEIKVLEGTILDNIIETVNGDVSISAAPESLSVSLINGDIRITAKEKTLRRVEASSANGNIKLALPNDLGVEGQVKTNLGSINSRLTDIEVVREKKDRGNQQLHFRRVLEESMAQINASTTTGSIFLKDTDK

SEQ ID NO: 445 - protein, 546 aa, Enterococcus faecalis
MKKYLKITMVCILLVGFLAGCTNKNENKKKQKNTKEAVQLMSPSELTTLNTSVLLDFPDAIVQTAAFEGLYSLDEQDQLVPAVAKALPMISEDGKTYTISLRKEAVWSNDDPVTAHDFEYAWKKMIDPKNGFVYSFLIVETIQNGAEISAGKLAPNELGVTAVDDYTLKVTLKEPKPYFTSLLAFPTFFPQNQKVVEQFGADYGTASDKVVYNGPFVVKDWQQTKMDWQLAKNNRYWDHQNVRSDIINYTVIKETSTALNLFEDGQLDVATLSGELAQQNKNNTLYHSYPTATMNYLRLNQKRKGQATPLANENLRKALALGIDKENLVNNIIADGSKALHGAITEGFVANPTTGLDFRQEAGNLMVYNKEKAQSYWKKAQAELGEKVNVELMVTDDGSYKKIGESLQGSLQELFPGLTIELTALPTEAALNFGRESDYDLFLIYWTPDYQDPISTLMTLYKGNDRNYQNPVYDKLLDEAATTYALEPEKRWATLIAAEKEVIETTAGMIPLSQNEQTVLQNDKVKGLNFHTFGAPLTLKNVYKEK

SEQ ID NO: 446 - protein, 1324 aa, Enterococcus faecalis
MKHGKIKRFSTLTLLASATILVPLSTSAEETTNSSTETSSSMVEPTATEEKLWQSDFPGGKTGEWQDVIGKTNRELAGESLAISRDAAAGNNAVSLNLDSPKLADGEVETKFKYTAGSGRTGVIIRGNTKDSWVFVGYNANGKWLVESPNSWNDSISGPTLNEDTNYLLKVRYVGEKITIWLNTTLIYEGEPVLANGDKIPTEAGHVGVRLWYDKKIVNYDYFKNGPVDSIPEIVPEVTQIAPVKVFTKIGVAPKLPKQVKVTYNTGKEANEAVRWNEIDPDAYKEPGTFEVDGTLENTNIKAKASIVVAKDNEAEKGDKISSADLTAVVDPQFPRIIRYEDPQSNQVIFNGQHEKIDQVMIDGKAYKATAEKQKSEANQAVYNVAVPEIGLRFTTTLTVSEGQELAMKLSDIREEGTKIHTISIPNQGLISVNSTDEGATFAGVVMNTGTNANNGNKNGDTIQDLTTTSQEETKKYMYGFLNTANYAASFWTNAYGDGSVDGSDNNRIHKQTKEAATGFVTTLSSGAWTYRPFDAPEDYTTGETPEVKVKFSKDSNDDNRVDWQDAAIGFRSIMNNPMGAEKVPELVNQRIPFNFASQATNPFLVTLDESKRIYNLTDGLGQMNLLKGYQNEGHDSAHPDYGAIGQRPGGEQALNQLIDEGHKLNAVFGVHINDTESYPEAKGFNEELVDPTKRGWDWLDPSYFIKQRPDTLSGRRYERFKELKQKAPNLDYIYVDVWGNQGESGWASRQLSKEINSLGWFTTNEFPNALEYDSVWNHWSAEKDYGGTTTKGFNSTIVRFIRNHQKDTWIISDNPLLGGAEFEAYEGWVGKTNFNTYRQKTFAINVPTKFLQHYQITNWETTTAADGQIYGTIKLANGAEKVTVTQADANSPRSITLNETEVLKGDAYLLPWNVNGQDKLYHWNPKGGTSTWSLDKKMQGKTNLHLYELTDQGRIDKGAIATTNNQVTIQAEANTPYVIAEPDSIEPMTFGTGTPFKDPGFNEANTLKNNWKVFRGDGEVKKDANGDYVFSSEKERTEIKQDINLPKPGKYSLYLNTETHDRKATVTVKIGGKKYTRTVNNSVAQNYIQADINHTSRKNPQYMQNMRIDFEIPDNAKKGSVTLAVDKGNSVTKFDDLRIVERQTDIMNPDKQTVIKQDFEDTQAVGLYPFVKGSAGGVEDPRIHLSERNEPYTQYGWNGNLVSDVLEGNWSLKAHKQGAGLMLQTIPQNIKFEPNKKYTVQFDYQTDGENVFTAGTINGELKNNNDFKPVGELTSTAADGQTKHYEAEIIGDASGNTTFGIFTTGADKDFIMDNFTVTVESKK

SEQ ID NO: 447 - protein, 510 aa, Enterococcus faecalis
LMKGNKILYILGTGIFVGSSCLFSSLFVAAEEQVYSESEVSTVLSKLEKEAISEAAAEQYTVVDRKEDAWGMKHLKLEKQTEGVTVDSDNVIIHLDRNGAVTSVTGNPVDQVVKIQSVDAIGEEGVKKIIASDNPETKDLVFLAIDKRVNNEGQLFYKVRVTSSPTGDPVSLVYKVNATDGTIMEKQDLTEHVGSEVTLKNSFQVAFNVPVEKSNTGIALHGTDNTGVYHAVVDGKNNYSIIQAPSLVALNQNAVDAYTHGKFVKTYYEDHFQRHSIDDRGMPILSVVDEQHPDAYDNAFWDGKAMRYGETSTPTGKTYASSLDVVGHEMTHGVTEHTAGLEYLGQSGALNESYSDLMGYIISGASNPEIGADTQSVDRKTGIRNLQTPSKHGQPETMAQYDDRARYKGTPYYDQGGVHYNSGIINRIGYTIIQNLGIEKAQTIFYSSLVNYLTPKAQFSDARDAMLAAAKVQYGDEAASVVSAAFNSAGIGAKEDIQVNQPSESVLVNE

SEQ ID NO: 448 - protein, 133 aa, Enterococcus faecalis
VQQNNNEISTQHQFDAYCKKVLRNEAKSIRKRNDKIKENEEPLNDLNEGKYSQTHLDEQDVYFLFGMEILISDQKLSAAIDQLSDTRKKIVLLYYFAGFNDTEIGKIFNMSTSGIWYQRTKAVEQLKMEYGLW

SEQ ID NO: 449 - protein, 707 aa, Enterococcus faecalis
MKKKLFRIVGIVFISILTLIVLLSLVGTVAEATGLVDDTVESGNLYSKYSLNNYQLDFFVDSSWDWLPWNWGDGLGKSVMYGLYAITNFIWTVSLYLSNATGYVVQEAYKLDFISDTAESIGKNIQTLADITENGLQTSGFYFGFLLLMILALGVYVAYTGLLKRETTKAVRAVINFVMIFLLSGSFIAYAPTYITKINDFSSDVSEAALTLGTEIVVPNSESQGKDSVDLIRDSLFSIQVQQPWLLLQFDDSNIEEIGEDRVNKILSVSPDENKGKDREEAVKAEIEDNDNANLSITKTMNRLGIVVFLVLFNIGISFFVFLLTGIMLFSQILFIIFAMFLPISFLLSMLPTYESLGKMAIIRLFNTIMMRAGVTLVITTAFSISTMFFNISATYPFFMVAFLQIVTFAGIYFKLGDIMSMFNLQSNDSQSMGRRVMRRPQMLMNRKLRQLNRNVGRTLAFGGAAAVGNKLAKEQSKPKFKPAGSSLRKNSRLPNDREVSSDSAKENPISNNKKQSRMNLTGRKIGKVLDTQALVKDKAKQVKDQVRNTPTNLKYILHKGLEKTKKAPKEFKRGLVQEKADREKLRDKQRQRRDEKMDEKRKNLGEVTDRHGKRRSNVSIKEDPKPQKDRILKNELPKRIVMVKPNSEVRRRLVKQNLVARENNQLLSKKNSFQQVKQRSTLPKRANQKVQRIMKARPKPKSGDKK

SEQ ID NO: 450 - protein, 893 aa, Enterococcus faecalis
MKKIISGMLICTVLLNSFSVIASGEELVKTETTGETGLVTQATSETTTNSTEDTSSVTEENTSERDSSTSSTKEESLDSSTNSTTEEHSSVSETNTTDSKTEASQSSEVEKKTIDQDEADYQEAAREGTNHKKGTYAMKNGLSSRVARATVANVYANDPNLPGKNFIDVSSWNGDISVAEYQKIKSYGVTGVSVKLTEGTWYVNPYAAGQIRNAKAAGLKVSAYHYSMYVSAATAQDEARYFAQAAANSGLDKNTIMFNDAEDPTLTNNGRNAHANSVAFNQQLKALGYKNDALYVGKWWLTNGYIDTSAFGRDRVWVAQYPYTPDSSMQWNNDHGAWQWSSQMYFPGLANYEGRPFDISMTYSNFLNMGNSSGPDLSKYYTTNPGRVIMKNDDTFYQDVAFRTPGWRVKKNTLVTIKGIEYSSAGIPRLVTDQGYLTANKDYVLAAQSNIDLYFTTNPKKVRLKSDDYFYADPEFKQRLSKVSKGTIVEVEDLAYTQSGIFRLKTAKGYLTANKNIVEQYKGLEDTYYTSNPGQVITRNEDTYYKDVEFKTKANKVSAGSVLKVTAIEKTKSGIPRLKMANGYYFTANKNYVVATGSWIANYHTVNPGQIIMKNSDNFYGDSDFLYKGAAVSKGSLVPVVGIEYRENQVPRLITQNGYLTANKSYAQKVVPNIKDYLYDYPEYVVMKTNDYYYQDVNFSKKGEFVSKDTLIKVLSVDYTENGLPRLKTAKGYITANKSYVTKLVSNSDNYFTENPHQIIMRVSDKLYTDVEFRNGSRTLSSGTVVPVKGIEYSSKGVPRLKTEGGYLTANKNYVTAAGNTNNNYFITNPKKVKLLIDDCFYNNTEFTKKGQAVKKNTIVEVEAIEYTNNGIPRLKTKQGYLTANKWYVAKVG

SEQ ID NO: 451 - protein, 1499 aa, Enterococcus faecalis
MNKAVKNFVSYLMITMLFILNLLPMMNAFAQEVTSDAEKTVEKDGLKVIGKIEDTSSQEDIKTVTYEVTNTRDVPIKDLILKQKNTNDSPIKFVLDTLSEERGPTSLEEQAKVETNEKDQTTDIKLLNLQPNSTRKITINGQITTKASNKLLVSVLIEDNEKGTLVIDLPSKDILADKESVSKEKQETSETKVENQANETASSTNEMTATTSNETKPEAGKAIESIQETALTQATESPEQPPLKAQPTGPLVPPTPGRGFNTPIYQSVHKGELFSTGNTNLKIANENTAAAQTFLNTRGASSGYAINNFPLEFADVDNDPNTYNSSRAYIDLNGAKEIAWAGLFWSASRYKGPAYGTNLSDEEISAPVQFTTPNGTVQRVSPQRYHRIDQDATNPGQRFGYNNTGFSNYADVTSILQGDKSATGSYTLADIPMTSSLNGQYQYYNFSGWSLFVVTKDQASKSRAFSIYYGARGNAAGTNNEFTMSNFLTAKQGNLDPIVTWFTVQGDKYWTGDNAQIKNSAGTWVNISNTLNPVNNAMNATVTDNDEHMVDKYPGKFAPDHPNFLDIDIDRMAIPEGVLNAGQNQINFRTTSSGDDYSTNAIGFAVNAETPEFEIKKEIVEPKETYKVGETITYRVSLKNTKADSEAINSVSKDALDGRLNYLPGSLKIISGPNSGEKTDASGDDQAEYDETNKQIIVRVGNGATATQGGSYKADTAETIYEFKARINERAKANELVPNSATVEAVDILTSAKVNETSNIVEAKIADEQVTGKLTATKTVNNAKPKLGEEIEYTISFRNTIENGILNKVVITDQLPKGLTYVKDSLTSVGDEPKPTSLKETNGTITAEYPSITDMKERSIRFKVIVNEEAKAGETILNKAKVDDTVNPPEEPEVPVVPETNAGKLAATKTVNNAKPKLGETIEYTISFRNTIENGVLNKVVITDQLPKGLTYVKDSLTSVGDEPKPTSLKEINGTITAEYPSITDTKERSIRFKVIVNEEAKAGETILNKAKVDDTVNPPEEPEVPVVPETNVGKLTATKTVNNAKPKLGEEIEYTISFRNTIENGVLNKVVITDQLPKGLTYVKDSLTSVGDEPKPTSLKEINGTITAEYPSITDTKERSIRFKVIVNEEAKAGETILNKAKVDDTVNPPEEPEVPVVPEAKEGKLTATKTVNNAKPKLGEAIEYTISFRNTIENGVLNKVVITDQLPKGLTYVKDSLTSVGDEPKPTSLTEANGTITAEYPSITDMKERSIRFKVIVNEEAKAGETILNKAKVDDTVNPPEEPEVPVVPEAKEGKLAATKTVNNAKPKLGETIEYTISFRNTIENGVLNKVVITDQLPKGLTYVKDSLTSVGDEPKPTSLKEANGTITAEYPSITDTKERSIRFKVIVNDEAKAGETILNKAKVGDGINPPEEPEVPITPEEPAKNKKETNKVVTDQNKPTKNSKNEIAINKKETSKSSYLPKTGEKVQKIFAYLGVGLILIVLILYVIKRNKEKEE

SEQ ID NO: 452 - protein, 925 aa, Enterococcus faecalis
VSRERFQAREKKVQKMGRDGLVEQNRATGEEKRVSQRTADTAFDRARPTEREDIRRPAARGADTGKKRKQPRTAPEMAAEQTEPLLTPEYLADSTAEPPPDAPASMRGAVDMPLLDAPIAEEPTPAPVRKQPQKRGKKGKKKQSTKFTEDAARPGSEEKTAMRGVEGAPAPKRRTSEGGSRLQFDKEEEPADPAADRAAIRKRQTAKLAEHAAKPEDKLKSDGNPKAGETRLKFEDTPKDTDISGDTAPDMPTRQQKKYNKAACRTERADRRVEQAQMKLPAKRRLHMDHQPDEASGKIKRRLRFEDEILPEYQKPSLSSRAGNAAKTAAVLKLHGKLREYERDNVALESAHKIELVAEQGAGRVLRWERNRRRSKPYRTLRKAQQKAARAHTDLAWQTALRDNPELQRKNALAKWVQKQKIKRKYAQAAHEAKQSAKFTQNVLTATGKIARAIAQYAAAHKAVFLAVAMLALVVMFFATGLTSCTAMLSGFQSSYISASYMANEQEICQSDLYYTEKETDLQIDIDKTEENYPGYDEYRYNIGEISHNPYELLGYLSTAFNAFTFAEVQPEIDRIFSRQYTLTREVIVETRYDDDGDPYDWYVLQTTLAVRPLSSVLQSSLTPGEQTDRYGVYMQTYGNRQAFGNPFGFSWLGYVSSGYGWRVHPVNGEKSLHRGIDLAVAQGTPILAAQDGRVVSAGDAGSYGLCVVIEDDKGYQSRYAHCSSLNVSAGQEVKRGDVIAAVGSTGNSTGPHLHLEVMLNGEYLNPYFFVDNGDDGTGAIPGTPGGPAIPDYSGEPMGDGSFEAMLREAEKYLGYPYVWGGSHPSTSFDCSGYVSWVINQSGVGSVGRQTAQGLYNLCTPVSAVNAQPGDLIFFTGTYSSPGPVSHVGIYVGGGRFIHCGDPISYANTGSPYWSAHLYGYGRIP

SEQ ID NO: 453 - protein, 394 aa, Enterococcus faecalis
MTNKEPWEAWSPAKVSSFQEDFLAWYEREKRNLPWRANTDAYRIWISEIMLQQTRVDTVIDYFYRFMEWFPTIQDLAEAPDDKLLKAWEGLGYYSRARNLKVAAQQIVSEFGGKMPDTIEDIRSLKGIGPYTAGAIGSIAFNLREPAIDGNVMRVVSRLFEIDADIAKASSRKVFEAAMLKIIDRERPGDFNQALMDLGSAVCTPTSPKCESCPLQQYCAAYQADKMTAYPVKSKKVKPKDVYYVGTIIENKKQEFLLEQRPETGLLANMWLFPIEEISKKQFQQLQKLAQPAETEKQLTLELEPVTEPLVAEEPVNFFTDYETVVWQKRTLGEVVHIFSHLKWHILVFYGRNTGELATLESQRWVAAQQFSDYVFPKPQQKMVELFKKEHEKK

SEQ ID NO: 454 - protein, 255 aa, Enterococcus faecalis
VEKSTVTSLTQETSATTINASTDSTALTAESEELPSLRQTLLNYVGMYGLTETLINRLSDDELDYAKKVSFHFVNQDISGTARMITKLYGEKPIPEDSYSTDYSTLTIDDLKNYLPQIRLSLIYVYDLNSDVVNNLSDQTLVDLINQVKVDYANQNYPSDVRGDYGLAAMADKIKANDYTSINQSAESVSSDTTNTESTLQTTTSSSKKATTSSSTEHKKGIFPSTGEKKSVLFTIIGIILLSLVSIFIIKNKKK

SEQ ID NO: 455 - protein, 433 aa, Enterococcus faecalis
MKKKILVGALVALFFMPLNVFAAKGDQGVDWAIYQGEQGRFGYAHDKFAIAQIGGYNASGIYEQYTYKTQVASAIAQGKRAHTYIWYDTWGNMDIAKTTMDYFLPRIQTPKNSIVALDFEHGALASVPDGYGGYVSSDAEKAANTETILYGMRRIKQAGYTPMYYSYKPFTLNHVNYQQIIKEFPNSLWIAAYPIDGVSPYPLYAYFPSMDGIGIWQFTSAYIAGGLDGNVDLTGITDSGYTDTNKPETDTPATDAGEEIEKIPNSDVKVGDTVKVKFSVDAWATGEAIPDWVKGNSYKVQEATGSRVLLEGILSWISKGDIELLPDATVVPDKQPETTHIVQHGETLSSIAYQYGTDYQTLASLNGLANPNLIYPGQVLKVNGSATSNVYTVQLGDNLSSIAAKLGTTYQTLAALNELANPNLIYPGQTLNY

SEQ ID NO: 456 - protein, 767 aa, Enterococcus faecalis
VSKQESDVVLNFKMNGEINYSRTIKDINKEMNLAATEYKNQVSAMDKNATQTEKLTATKKKLEKQLSLAEQRTKLLREEYEKSVKETGEYSEQSQKLYKRLLESETGENKLRSALQSTNEALKEQGNLSIKTAEKLAKIEKAGDKIKSVGQKLSVGLTAPIMGIGAASIAAFKELDECLDNITTATGATGSQLESLQASFKTVAGQIPADMQDISTGIGEVNTQFGLMDKQLEDTTGRMLKFSEINGSDVSQSTINAKKSMDLFRLSIEDLPMILDSVSKTSQDTGVGVDQLFDAVNRGAPQLKAMGLGFSESTTLIGQMEKAGIDSAGTLGYLAKASVVYAKDNKTMQEGLSGTIESIKGATTEQEKLTIASEVFGTKAASKMVEAIDSGALSMDGLADSAKNAAGTVDQTFSDILDPIDQAKLAQNQFKIAMGELGEQVQIALLPAFQAATDAIKKVSEWFGSLTDSQKQTILKIAGVVAAIGPVLVVLGTLASSISSLIPVIAFIASPIGLVIAAVAAWVAAIVVAYNKIGWFRDFINTSFKVIKDIVVGVFNVLKDTTKSTFDFITGFIGGAMDGAAKIIGDYVNEIKRIFGGIVDFVTGVFTGDWSRAWQGVVDIFGGIFEGIAAVAKAPINAMITLINGFIGGLNNIKIPKWVPGIGGKGFHIGKIPYLAEGGTILNGQAIVGEAGPELLTAKNGKTTVTPLSPEEKARGIGGALKGGNTIEQHVHIGQVDANNPSELDRMNRKLYKASAQAFYDLGGVPT

SEQ ID NO: 457 - protein, 454 aa, Enterococcus faecalis
MNKELLRQLQARHEKRLSDLQGKIESGEVREADLDSVNEEIDGLIDELKAIKAELGDDNSESGDGEGDDGTAKSDNTDDESKEDREKDTNGNNDDKNEENRGGMISQEQRDGLLRTIHEGMEARNVMSNEQREKQIRKAFADFVIGNISESEARALGIETGNGSVTVPEVIASEVISYAQEENLLRKYGTVIRTAGDVKYPILVKKAEANVNKKERTTDITETAIQFDEILLDPAEFDALATVTKKLLKMSGVPVEDIVVEELKKAYVRKEINYMFNGDDAGNENPGALAKKAVAFEKPVDLTAAGAGQKLYDALIEFKNTPVTEVMKKGRFIINRAALTAIEKMKTDDGFPLLRPFTQAEGGIGYQLVGYPVDWTDAADKKGEPDTPVLYFGDFSAFKIQEVIGALEIQKLVEKFSGKNQVGFQIYNLLDGQLVYSPFEPAVYRYEITKPVGG

SEQ ID NO: 458 - protein, 317 aa, Enterococcus faecalis
MKKKFLAMMAVSMMGLLMLSACQTNKKTADSATTETTAKTEVTVKDTNGQLTVPKNPKKVVVFDNGSLDTMDALGVGDRVVGAPTKNIPAYLKKYQKVESAGGIKEPDLEKINQLKPDLIIISGRQQDYQEQLKAIAPTIYLAVDAKNPWASTKQNIETLGTIFDKEEVAKEKITGLEKEIADVKKQAEASANNALVVLVNEGQLSAYGKGSRFGLIHDTFGFKAADDKIEASTHGQSVSYEYVLEKNPGILFVVDRTKAIGGDDSKDNVAANELIQKTDAGKNDKVIMLQPDVWYLSGGGLESMHLMIEDVKKGLE

SEQ ID NO: 459 - protein, 309 aa, Enterococcus faecalis
MKVNKFVKGFAAIALSSLVLAACGADKKDNTTNSSSAASSETKKSTESSAPAKKVAGGDLKDGTYKLEEKNEKNGYRAVFEMTVKDGKITESKYDNINADGKSKTEDTKYEESMKAKSGVGPKEYIKQLNDSFVKAQSASGVEVVTGATHSSESFQNYAQQLIQAAQAGNTDTIEIDNGATLKDGTYSLKEKNDSNGYHTTFSMTVKDGKVTESNYDNVNADGKSKKDDTEYESKMKDVAGVGPKEYIETLNKEFVKAMGEEDGSPAGVEVVTGATHSTHSFINYAQQLVNAAEKGDTTEIVVDNIVTK

SEQ ID NO: 460 - protein, 251 aa, Enterococcus faecalis
MDFQNIQTVKELRYALKQYKQTLATTIFDDTQGYISVAFKKEVIEKDGKNVQFLCFYPNYEVALYPVETLLAYLEKLPEQAIVTIKDHDGNYSSLFLTIDETIDQGNNYQWLVISDKNSYERFFFTAQESTQEQAFEKMLKELETDHDSTLEVVHNWLCRQTDEALFLGILKEDRTLKGAMTYCIGKAQEQSKDQSSAMVADEVVFSWIKEYFLLEKLPETKAVGKVTTKKSETKPERKEVDEQIDLFECV

SEQ ID NO: 461 - protein, 86 aa, Enterococcus faecalis
MIILSGLFILGIGIVGGYQLATLPKLIEMKQHKAIQNHFNVKGNEYTYYQEDSENYILSLEDTEYRIKFSKNTPLKVVFTEILEPM

SEQ ID NO: 462 - protein, 890 aa, Enterococcus faecalis
MKKIASTGLSILVATGVAGIGGNEVQAAEQAQPKTPENSSTEQPTVKATQTTEQAITEKQQQVTEKQAIVDQKQQVADTAKKEKDAIDQSVKDQQAVVDQNKDALDQSQQAVTDQQAVVDEAKKVVDEATPSAIEKAKEQVATDTQAVDDQQKVVDQAQTDVNQQQAVVEEKAKETNAAKVQNDKDQQAVTAAKQEQAKLEELAKNAEAEKAKAEKEQAAKEAELANKQKEEAKAKDQKTKDDQAVADQQSVVTTSQEKVADAKADTAAKQADLTSKENALKDKQAATKQAQNTLDSSKEELKGHKGLNLPANFTPDYYKKLTEQEKQAMEKEALALNKVFPENQADAAKVTEMINVKNPTEKQKQQMSDYVVGLINDVREKLGLQKLKISNQAMKFAWDVAKYDNPKEFDHDVNAINRAAKENGFKEFPGQNFYENLSMGRFTTQEGKVSMYDFEKAARNALVSMLMNDGHSGYSHLDSLLDANETNMAVSISGDLNDISAKIHIISYNQTKLVEANTYEEGTAPVFKSKETLQKEVATNQEKLATAQQAESDAQQARSASQQALNTAKTTQATAEKELSVHKATLANLQAVATKSTTNYEEKVRQTAAAETNLQQTKDQLATINELIQNRAVVLEKAKTKVADAQAIEQTSAKVLKEKQEAQKAEENTLNSLKEVLDLAKENLNQKQVALKTSTRSLARLENAQPTYEKAVNELNKAEAAVVQAKEAYENSLKSLEELKEQQAVATLAYTQAQEDLSNAKLELQQYQGILRDLEAQQAEQRRQEALQEQVAKEQQRLEREAKQQQMLVASATSADKTPGLQQLSFSKQKEQPKAQTLTHSEPRKTKQVAKAQESLPHTGEQKSIWLTIFGLFMAVGAISFKNKRRKNS

SEQ ID NO: 463 - protein, 529 aa, Enterococcus faecalis
VLLVFASCGVNKSTEDSKKTNETKVEQIATLSAGTPVQSLDPATAVDQTSVTLLANVMEGLYRLDEKNQPQPAIAAGQPKISNGGKTYTIVIRDGAKWADGTDITADDFVTAWQRVLDPKTASPNVELFAAIKNAKEISIGKQQKETLGVKSKGNKTIEIELEEPTPYFTDLLALTAYFPVQQNAVKEYGKEYGTTKENIVTNGAFTLTDLNGVGISDKWTIAKNPKYWDKKHVAMEKIKFQVVKDINTGINLYNDGQLDDAPVAGEYSKQLENNKDFIRELSATTMFLEVNQRNKKSITSNKHARQAINFAIDREAISNKILTNGSIPAKGVVPSKLVYNPKTGKDFTNSSLVFLDKSKAKDSWEKAKKELKGTDLSIDIMVNEEDLSKKLGEYLQNELQDTLDGLKVSVTAVPATLQTERLNSGNFMIALSGWQADFADPVSFLANFESKSSLNHGGYANEEYDKLLKNNSSKRLQELKDAEKLILEDAGVIPLLQIGNAKLRNQKISEMKVHSIGAKYDYKTMEIK

SEQ ID NO: 464 - protein, 285 aa, Enterococcus faecalis
MKKIILSSLFSAVLVFGGGSITAFADDLGPTDPATPPITEPTDSSEPTNPTEPVDPAEPPVIPTDPTEPSKPTEPTTPSEPEKPTEPTTPIDPGTPVEPTEPSEPTEPSQPTEPTTPSEPEKPVTPEQPKEPTQPVIPEKPAEPETPKTPEQPTKPIDVVVTPSGEIDKTNQSAGTQPSIPIETSNLAEVTHVPSETTPITTEAGEEIVAVDKGVPLTKTPEGLKPISSSYKVLPSGNVEVKASDGKMKVLPHTGEKFTLLFSVLGSFFVLISGFFFFKKNKKKA

SEQ ID NO: 465 - protein, 871 aa, Enterococcus faecalis
MVESKRTWKEKVHVESQVEERLRKNLTLKSREATKLQKKALKTTKKEFKLSKKNYKQSLKKHKLTLKTGKEPLSINHLLDKKKFVEQKKRKKAQKIAYKRTKKVDETRVVNQVKRETKEGLKREATQKVRTTLTQEDTLNEAMTLYEKTQQAKFNMRTALKTGKTVKNLSVKTAKDTYGLGNRLFNFSRGRGFQRTPKDFTLKKQLMKQLRNRAMRFKAAKEAKKAEQGIGLIRSFFNGQKTLGKVAALILKNPISWVVLLVLFLVFLLSGVASSTQKPAIVQEEEDLTASWTYFTKLDAQHTDDNNLFYSNIDDVLFYMNYRYDDFKLLDMDSTGTKNFETILSELWTALNGKKPDYQLKTMQSLETDKKSSYFIEEEQAKHYQEIKKELGYQTLDDLLSFPVKTDALIVNKRYGYDKSKEKLTLYKGIDVLIEDNQPFHSPMNGQIVSVPDTETLVIEKEKVARLTIRGVNTLRLTKGMDVEEGTFLGNTKNSTVTFQYEKYKKETKDWFFVNPAFYFPRVTYTQTTLLGSAEFSPGASVEKRAQAVYDYLSKKGYTKEGISAILGNFSVESGINPKRAEGDYLNPPVGAHGNSWDEPSWLAMGGPQIYGGRFPNILHRGLGLGQWTDTADGGRRHTLLLDYAKGKNKKWYDLQLQLDFIFDGDAPGSRTAADNVARSKVAATIPELTTYYLTVWEGNPGDKLGERIQAAQNWFTFFSRSGTPIGGSGSEVFAQYKEKMQPLPTDRETKAGQGWPGNAYAPGNCTWYVFNRFAQLGKSIYPTMGNANQWVHNYSQTPGATLESAPKKGDAVIFTNGVAGSSTQYGHVAYVEHVNSDGSFVISEMNVSGEYSMNWRVLKKEAGEYFMRLN

SEQ ID NO: 466 - protein, 390 aa, Enterococcus faecalis
MTQVHFTLKSEEIQSIIEYSVKDDVSKNILTTVFNQLMENQRTEYIQAKEYERTENRQSQRNGYYERSFTTRVGTLELKVPRTRDGHFSPTVFERYQRNEKALMASMLEMYVSGVSTRKVSKIVEELCGKSVSKSFVSSLTEQLEPMVNEWQNRLLSEKNYPYLMTDVLYIKVREENRVLSKSCHIAIGITKDGDREIIGFMIQSGESEETWTTFFEYLKERGLQGTELVISDAHKGLVSAIRKSFTNVSWQRCQVHFLRNIFTTIPKKNSKSFREAVKGIFKFTDINLAREAKNRLIHDYIDQPKYSKACASLDDGFEDAFQYTVQGNSHNRLKSTNLIERLNQEVRRREKIIRIFPNQTSANRLIGAVLMDLHDEWIYSSRKYINFDK

SEQ ID NO: 467 - protein, 29 aa, Enterococcus faecalis
PSEKGNQGRVEKRSDAKSTNHVNAGRYTE

SEQ ID NO: 468 - protein, 71 aa, Enterococcus faecalis; identical to SEQ ID NO: 268

SEQ ID NO: 469 - protein, 35 aa, Enterococcus faecalis
LNKRACESRSCLRSRNPRGKRNVQCDYCKCRKSAC

SEQ ID NO: 470 - protein, 44 aa, Enterococcus faecalis
VPTLLTNQLSVCQKHGGQLFQIFTKVGHRLLKQGPTLPKLLKKC

SEQ ID NO: 471 - protein, 26 aa, Enterococcus faecalis
KRLQKKLKKSISQPIRTEKVKQLLGI

SEQ ID NO: 472 - protein, 42 aa, Enterococcus faecalis
MALLPNVTSKPAHGVAIPVTGTFKPKKVTTMPLTIPENKFVA

SEQ ID NO: 473 - protein, 60 aa, Enterococcus faecalis
SCAFCHVSFVGKYFRSPATGTTTIPAFAVIRKFNALTRSARASGEEKAISADNTSSTGNR

SEQ ID NO: 474 - protein, 24 aa, Enterococcus faecalis
GSIVDNSPDINAIGPAKNKTAKIV

SEQ ID NO: 475 - protein, 44 aa, Enterococcus faecalis
SQGQCYGQLMLLQYKLFQNHKLDHKKDDLCANWSTSLKQLPCFP

SEQ ID NO: 476 - protein, 134 aa, Enterococcus faecalis
SFVQSSYCSSLRAFSGKIKFKTIPKTVANAIEDNSKVPTLKTKPPMPMTKITEAINKFFFLSKLILLSIKIFKPLAAITPNKTKLIPEITGPGILRIKALNFPTKPKATANTAAPPITKTLCTLVIASTPIFSP

SEQ ID NO: 477 - protein, 11 aa, Artificial Sequence
  Description of Artificial Sequence:  Synthetic Peptide
KLKLLLLLKLK

SEQ ID NO: 478 - protein, 36 aa, Artificial Sequence
  Description of Artificial Sequence:  Synthetic Peptide
RLAGLLRKGGEKIGEKLKKIGQKIKNFFQKLVPQPE

SEQ ID NO: 479 - protein, 11 aa, Artificial Sequence
  Synthetic Peptide
KLKLLLLLKLK

SEQ ID NO: 480 - protein, 36 aa, Artificial Sequence
  Synthetic Peptide
  variation (22)..(22): Xaa is ornithine
RLAGLLRKGGEKIGEKLKKIGXKIKNFFQKLVPQPE

The invention claimed is:

1. An isolated antigenic polypeptide fragment of SEQ ID NO: 197 consisting of an amino acid sequence selected from the group consisting of amino acids 6-21, 34-44, 58-64, 66-74, 79-87, 114-127, 129-143, 154-162, 174-189, 205-214, 241-262, 266-273, 278-297, 319-324, 328-338, 342-351, 390-398, 409-415, 422-435, 458-464, 471-477, 481-486, 506-531, 534-540, 542-550, 315-389, 316-343, 339-366 and 362-389 of Seq ID No 197.

2. An immunogenic composition comprising an isolated antigenic polypeptide fragment of Seq ID No: 197 wherein the antigenic polypeptide fragment comprises one or more of amino acids 6-21, 34-44, 58-64, 66-74, 79-87, 114-127, 129-143, 154-162, 174-189, 205-214, 241-262, 266-273, 278-297, 319-324, 328-338, 342-351, 390-398, 409-415, 422-435, 458-464, 471-477, 481-486, 506-531, 534-540, 315-389, 316-343, 339-366 and 362-389 of Seq ID No: 197, and wherein the antigenic polypeptide fragment does not include amino acids 542-550 of SEQ ID No:197.

3. The immunogenic composition of claim 2, comprising at least two different antigenic polypeptide fragments.

4. The immunogenic composition of claim 2, further comprising an immunostimulatory substance.

5. The immunogenic composition of claim 2, wherein the immunostimulatory substance is a polycationic polymer, an immunostimulatory oligodeoxynucleotide (ODN), a peptide containing at least two LysLeuLys motifs, a neuroactive compound, alum, or a Freund's complete or incomplete adjuvant.

6. The immunogenic composition of claim 5, wherein the polycationic polymer is a polycationic peptide.

7. A method of inducing an immunological response in a subject comprising administering the immunogenic composition of claim 2 to a subject, wherein an immunological response against the isolated antigen fragment in the immunogenic composition is induced in the subject.

8. The method of claim 7, wherein the subject is a human.

9. The method of claim 7, wherein the subject has an *E. faecalis* infection.

10. The method of claim 7, wherein the immunogenic composition comprises at least two different antigen fragments.

11. A fusion protein comprising one or more antigenic polypeptide fragments according to claim 1, wherein the fusion protein does not include amino acids 542-550 of SEQ ID NO:197.

12. The fusion protein according to claim 11,
a) wherein the fusion protein further comprises at least one amino acid residue heterologous to the polypeptide, and/or
b) wherein the fusion protein further comprises a leader or a secretory sequence, a sequence employed for purification, or a proprotein sequence.

13. The fusion protein according to claim 12, wherein the fusion protein further comprises a marker protein.

14. The fusion protein according to claim 12, wherein the at least one amino acid residue heterologous to the polypeptide is flanking the polypeptide N-terminally, C-terminally, or N- and C-terminally.

15. An immunogenic composition comprising an isolated antigenic polypeptide fragment of Seq ID No: 197, wherein the antigenic polypeptide fragment consists of an amino acid sequence selected from the group consisting of amino acids 315-389, 316-343, 339-366 and 362-389 of Seq ID No: 197, and wherein the antigenic polypeptide fragment is not Seq ID No: 197.

16. The immunogenic composition of claim 15, comprising at least two different antigenic polypeptide fragments.

17. The immunogenic composition of claim 15, further comprising an immunostimulatory substance.

18. The immunogenic composition of claim 17, wherein the immunostimulatory substance is a polycationic polymer, an immunostimulatory oligodeoxynucleotide (ODN), a peptide containing at least two LysLeuLys motifs, a neuroactive compound, alum, or a Freund's complete or incomplete adjuvant.

* * * * *